US011919944B2

(12) United States Patent
Emig et al.

(10) Patent No.: US 11,919,944 B2
(45) Date of Patent: Mar. 5, 2024

(54) ANTIBODIES FOR SARS-COV-2 AND USES THEREOF

(71) Applicant: Augmenta Bioworks, Inc., Menlo Park, CA (US)

(72) Inventors: Christopher J. Emig, Menlo Park, CA (US); Rosanna Man Wah Chau, San Mateo, CA (US); Payam Shahi, Santa Clara, CA (US); Kim-Xuan Nguyen, Sunnyvale, CA (US); Yushuan Lai, San Jose, CA (US); Robin Emig, Pleasanton, CA (US); John Beaber, Redwood City, CA (US); Steven Henry, San Mateo, CA (US); Marco Antonio Mena, Santa Clara, CA (US)

(73) Assignee: Augmenta Biosciences, Inc., 3475 Edison Way, CA (US)

(*) Notice: Subject to any disclaimer, the term of this patent is extended or adjusted under 35 U.S.C. 154(b) by 137 days.

(21) Appl. No.: 17/315,326

(22) Filed: May 9, 2021

(65) Prior Publication Data

US 2021/0347860 A1 Nov. 11, 2021

Related U.S. Application Data

(60) Provisional application No. 63/108,386, filed on Nov. 1, 2020, provisional application No. 63/023,177, filed on May 11, 2020.

(51) Int. Cl.
*C07K 16/10* (2006.01)
*A61P 31/14* (2006.01)

(52) U.S. Cl.
CPC .............. *C07K 16/10* (2013.01); *A61P 31/14* (2018.01); *C07K 2317/76* (2013.01); *C07K 2317/92* (2013.01)

(58) Field of Classification Search
CPC . A61P 31/14; C07K 2317/76; C07K 2317/21; C07K 2317/92
See application file for complete search history.

(56) References Cited

U.S. PATENT DOCUMENTS

2003/0099647 A1 5/2003 Deshpande et al.
2010/0310463 A1 12/2010 Cicortas et al.
2015/0133317 A1 5/2015 Robinson et al.
2016/0347849 A1 12/2016 Cai et al.
2018/0002412 A1 1/2018 Claffey et al.

FOREIGN PATENT DOCUMENTS

| | | |
|---|---|---|
| CN | 102283810 | 12/2011 |
| WO | WO 2006/014498 | 2/2006 |
| WO | WO 2007/044695 | 4/2007 |
| WO | WO 2009/104100 | 8/2009 |
| WO | WO 2011/130417 | 10/2011 |
| WO | WO 2014/145907 | 9/2014 |
| WO | WO 2015/135035 | 9/2015 |
| WO | WO 2015/164723 | 10/2015 |
| WO | WO 2016/187216 | 11/2016 |
| WO | WO 2016/197071 | 12/2016 |
| WO | WO 2017/096397 | 6/2017 |
| WO | WO 2018/098363 | 5/2018 |
| WO | WO 2019/028530 | 2/2019 |
| WO | WO 2019/075433 | 4/2019 |
| WO | WO 2019/126398 | 6/2019 |
| WO | WO 2019/224711 | 11/2019 |
| WO | WO 2019/232503 | 12/2019 |
| WO | WO-2021207948 A1 * | 10/2021 |

OTHER PUBLICATIONS

LV et al, Cross-reactive antibody 1 response between 2 SARS-CoV-2 and SARS-CoV infections, 2020, biorxiv 10.1101/2020.03.15.993097v1.
UniProt Acc No. AOA5C2FYF3, UniProtKB AOA5C2FYF3, 2019.
UniProt Acc No. AOA5C2GL41, UniProtKB AOA5C2GL41, 2019.
UniProt Acc No. AOA5C2FVU7, UniProtKB AOA5C2FVU7, 2019.

* cited by examiner

*Primary Examiner* — Janet L Andres
*Assistant Examiner* — Ruixue Wang
(74) *Attorney, Agent, or Firm* — HelixIP LLP

(57) ABSTRACT

The disclosure relates generally to the field of immune binding proteins and method for obtaining immune binding proteins from genomic or other sources. The disclosure also relates to anti-SARS-CoV-2 antibodies that have been obtained from subjects who became immune to this coronavirus, and to methods of using these anti-SARS-CoV-2 antibodies. Methods for neutralizing SARS-CoV-2 are disclosed, as well treatments for SARS-COV-2 using the anti-SARS-CoV-2 antibodies.

14 Claims, 3 Drawing Sheets

Specification includes a Sequence Listing.

ANTIBODIES FOR SARS-COV-2 AND USES THEREOF

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "ABW020_ST25.txt", a creation date of May 9, 2021, and a size of 972 kilobytes. The Sequence Listing filed via EFS-Web is part of the specification and is incorporated in its entirety by reference herein.

BACKGROUND OF THE DISCLOSURE

There is considerable interest in being able to discover antibodies to specific antigens. Such antibodies are useful as research tools and for diagnostic and therapeutic applications. However, the identification of such useful antibodies is difficult and once identified, these antibodies often require considerable redesign before they are suitable for therapeutic applications in humans.

Many methods for identifying antibodies involve display of antibody libraries derived by amplification of nucleic acids from B cells or other tissues. These approaches have limitations that limit the useful antibodies obtained from the library. For example, most antibody libraries do not pair the heavy and light chains obtained from memory B-cells or plasma cells that have mounted an effective immune response against an immunological challenge. In addition, most human antibody libraries known contain only the antibody sequence diversity that can be experimentally captured or cloned from a biological source (e.g., B cells). Accordingly, such libraries may over-represent some sequences, while completely lacking or under-representing other sequences especially paired light and heavy chains that form useful antibodies, particularly those from a successful immune response.

It is an object of this invention to provide libraries of immune binding proteins that are enriched for useful immune binding proteins. It is also an object of the invention to provide methods for making such libraries that are enriched for useful multimers of immune binding proteins. It is a further object of the invention to provide methods for amplifying nucleic acids from B-cells and plasma cells so that the pairing of light and heavy chains is maintained. It is an object of the invention to obtain libraries of antibodies relevant to disease therapies by obtaining paired light and heavy chain antibodies from individuals whom have mounted antibody responses against a variety of immunologic challenges related to, for example, infectious diseases (an infectious agent), cancer, auto-immune disease, neurodegenerative disease, and allergies.

SARS-CoV-2 is the causative agent, the virus that causes, COVID-19. It is novel coronavirus that first infected humans starting in December 2019. At the time of the filing of this application SARS-CoV-2 had infected at least 1,279,546 person in the United States, and had killed at least 76,527 persons. There is a present unmet medical need for therapies to treat SARS-CoV-2 infections and reduce the morbidity and mortality of this disease in the United States and around the world.

SUMMARY OF THE INVENTION

The disclosure relates to antibodies obtained from subjects who acquired immunity to coronavirus, SARS-CoV-2. Over a thousand human antibodies have been obtained from these subjects in a screening to identify antibody clones that bound to targets from SARS-CoV-2. The targets or mixture of targets used to identify the anti-SARS-CoV-2 antibodies were SARS-CoV-2 Spike 1 Protein (S1), SARS-CoV-2 Spike 2 Protein (S2), SARS-CoV-2 Receptor Binding Domain, SARS-CoV-2 Spike 1 Protein OR SARS-CoV-2 Spike 2 Protein (S1+S2), SARS-CoV-2 Spike 1 Protein OR SARS-CoV-2 S2 Protein OR SARS-CoV-2 Membrane Protein OR SARS-CoV-2 Envelope Protein (S1+S2+E+M). The nucleic acid and amino acid sequences of the variable region heavy chains and light chains for these anti-SARS-CoV-2 antibodies are disclosed herein. The antibodies can be monoclonal, and can be fully human antibodies, chimeric antibodies, or CDR-grafted antibodies. The antibodies can be full length or and antibody fragment. Antibody fragments include any of the well-known formats or types, including for example, antigen-binding fragments (Fab), single chain variable fragments (scFv) and "third generation" (3G).

Specific antibodies disclosed herein include, for example, anti-SARS-CoV-2 (SC2) antibody 3417 (SC2 Ab 3417 or 3417), SC2 antibody 3387 (3387), SC2 antibody 3705 (3705), SC2 antibody 3388 (3388), SC2 antibody 3396 (3396), SC2 antibody 3908 (3908), SC2 antibody 3916 (3916), SC2 antibody 3929 (3929), SC2 antibody 3940 (3940), SC2 antibody 4021 (4021). Several antibodies, including SC2 antibody 3387 (3387) and SC2 antibody 3705 (3705) have shown affinity for various variants of SARS-CoV-2 now present in the population. Several antibodies including SC2 antibody 3387 (3387), SC2 antibody 3705 (3705), SC antibody 3396, and SC2 antibody 3417 (3417) have also shown neutralizing activity against SARS-CoV-2.

The anti-SARS-CoV-2 antibodies can be full length antibodies such as, for example, an IgG (e.g., IgG1, IgG2, IgG3, or IgG4), an IgM, an IgA, an IgD, or an IgE. The anti-SARS-CoV-2 antibody can be an antibody fragment such as, for example, a Fab, F(ab')2, single chain antibody (scFv), Fv, or other antibody fragments made from recombinant nucleic acids encoding fragments of the antibody chains. The antibody fragments can also be made by digestion of an anti-SARS-CoV-2 antibody to generate a smaller fragment. The anti-SARS-CoV-2 antibody can be obtained from a B-cell, a plasma cell, a B memory cell, a pre-B-cell or a progenitor B-cell.

Compositions and formulations described here can comprise one or more of the anti-SARS-CoV-2 antibodies for administration to a subject. The compositions with the anti-SARS-CoV-2 antibodies can also include other drugs or agents for treatment of the subject. For example, the anti-SARS-CoV-2 antibody compositions can include analgesics, other antiviral drugs, other antiviral antibodies, and/or agents that reduce symptoms caused by infection with SARS-CoV-2.

Methods described herein use the anti-SARS-CoV-2 antibodies to neutralize (e.g., in vitro or in vivo or both) the SARS-CoV-2 virus and inhibit the virus from infecting cells. The methods can be used to treat subjects with active infections from SARS-CoV-2 and thereby reduce the symptoms in a subject, time of infection of the subject, or transmission of virus to others by the infected subject. The methods can also be used prophylactically to reduce, inhibit, or prevent infection of a subject by the SARS-CoV-2 virus.

DETAILED DESCRIPTION OF THE INVENTION

Figure 1:
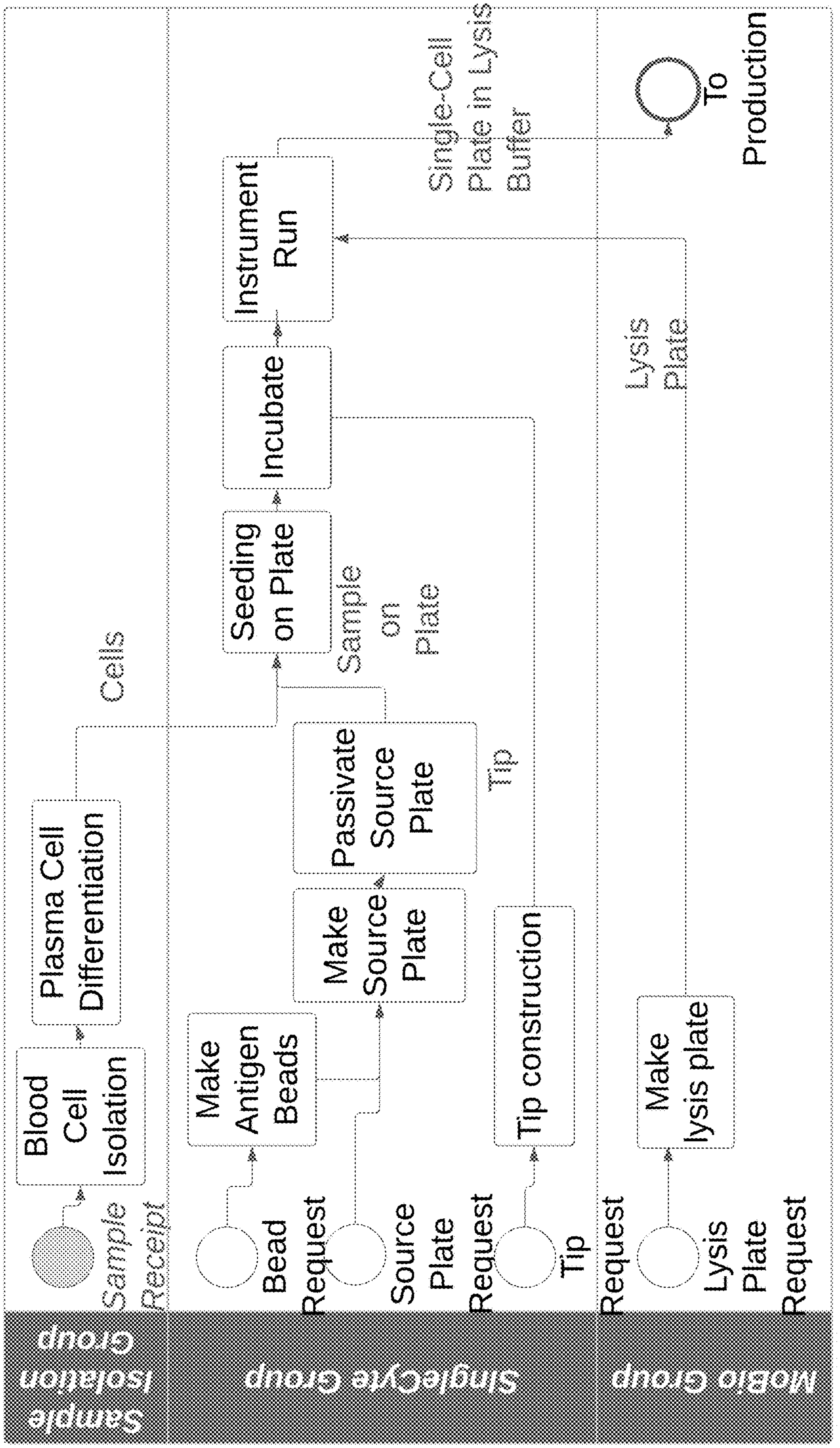
FIG. 1 (3) shows a work flow chart for obtaining clones expressing a desired antigen binding protein using a single cell selecting device.

Before the various embodiments are described, it is to be understood that the teachings of this disclosure are not limited to the particular embodiments described, and as such can, of course, vary. It is also to be understood that the terminology used herein is for the purpose of describing particular embodiments only, and is not intended to be limiting, since the scope of the present teachings will be limited only by the appended claims.

Unless defined otherwise, all technical and scientific terms used herein have the same meaning as commonly understood by one of ordinary skill in the art to which this disclosure belongs. Although any methods and materials similar or equivalent to those described herein can also be used in the practice or testing of the present teachings, some exemplary methods and materials are now described.

It must be noted that as used herein and in the appended claims, the singular forms "a", "an", and "the" include plural referents unless the context clearly dictates otherwise. It is further noted that the claims can be drafted to exclude any optional element. As such, this statement is intended to serve as antecedent basis for use of such exclusive terminology as "solely," "only" and the like in connection with the recitation of claim elements or use of a "negative" limitation. Numerical limitations given with respect to concentrations or levels of a substance are intended to be approximate, unless the context clearly dictates otherwise. Thus, where a concentration is indicated to be (for example) 10 micrograms ("μg"), it is intended that the concentration be understood to be at least approximately or about 10 μG.

As will be apparent to those of skill in the art upon reading this disclosure, each of the individual embodiments described and illustrated herein has discrete components and features which can be readily separated from or combined with the features of any of the other several embodiments without departing from the scope or spirit of the present teachings. Any recited method can be carried out in the order of events recited or in any other order which is logically possible.

Definitions

As used herein, an "antibody" refers to a protein functionally defined as a binding protein and structurally defined as comprising an amino acid sequence that is recognized as being derived from the framework region of an immunoglobulin encoding gene of an animal producing antibodies. An antibody can consist of one or more polypeptides substantially encoded by immunoglobulin genes or fragments of immunoglobulin genes. The recognized immunoglobulin genes include the kappa, lambda, alpha, gamma, delta, epsilon and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

A typical immunoglobulin (antibody) structural unit is known to comprise a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain ($V_L$) and variable heavy chain ($V_H$) refer to these light and heavy chains respectively.

Antibodies exist as intact immunoglobulins or as a number of well-characterized fragments. Thus, for example, pepsin digests an antibody below the disulfide linkages in the hinge region to produce $F(ab)'_2$, a dimer of Fab which itself is a light chain joined to VH-CH1 by a disulfide bond. The $F(ab)'_2$ may be reduced under mild conditions to break the disulfide linkage in the hinge region thereby converting the $(Fab')_2$ dimer into an Fab' monomer. The Fab' monomer is essentially an Fab with part of the hinge region (see, Fundamental Immunology, W. E. Paul, ed., Raven Press, N.Y. (1993), for a more detailed description of other antibody fragments). While various antibody fragments are defined in terms of the digestion of an intact antibody, one of skill will appreciate that fragments can be synthesized de novo either chemically or by utilizing recombinant DNA methodology. Thus, the term antibody, as used herein also includes antibody fragments either produced by the modification of whole antibodies or synthesized using recombinant DNA methodologies. Preferred antibodies include $V_H$-$V_L$ dimers, including single chain antibodies (antibodies that exist as a single polypeptide chain), such as single chain Fv antibodies (sFv or scFv) in which a variable heavy and a variable light region are joined together (directly or through a peptide linker) to form a continuous polypeptide. The single chain Fv antibody is a covalently linked $V_H$-$V_L$ heterodimer which may be expressed from a nucleic acid including $V_H$- and $V_L$-encoding sequences either joined directly or joined by a peptide-encoding linker (e.g., Huston, et al. Proc. Nat. Acad. Sci. USA, 85:5879-5883, 1988). While the $V_H$ and $V_L$ are connected to each as a single polypeptide chain, the $V_H$ and $V_L$ domains associate non-covalently. Alternatively, the antibody can be another fragment. Other fragments can also be generated, including using recombinant techniques. For example, Fab molecules can be displayed on phage if one of the chains (heavy or light) is fused to g3 capsid protein and the complementary chain exported to the periplasm as a soluble molecule. The two chains can be encoded on the same or on different replicons; the two antibody chains in each Fab molecule assemble post-translationally and the dimer is incorporated into the phage particle via linkage of one of the chains to g3p (see, e.g., U.S. Pat. No. 5,733,743). The scFv antibodies and a number of other structures converting the naturally aggregated, but chemically separated light and heavy polypeptide chains from an antibody V region into a molecule that folds into a three-dimensional structure substantially similar to the structure of an antigen-binding site are known to those of skill in the art (see e.g., U.S. Pat. Nos. 5,091,513, 5,132,405, and 4,956,778). In some embodiments, the scFv is a diabody as described in Holliger et al., Proc. Nat'l Acad. Sci. vol. 90, pp. 6444-6448 (1993), which is incorporated by reference in its entirety for all purposes. In some embodiments, antibodies include all those that have been displayed on phage or generated by recombinant technology using vectors where the chains are secreted as soluble proteins, e.g., scFv, Fv, Fab, pr $(Fab')_2$ or generated by recombinant technology using vectors where the chains are secreted as soluble proteins. Antibodies can also include diantibodies and miniantibodies.

Antibodies of the invention also include heavy chain dimers, such as antibodies from camelids. Since the $V_H$ region of a heavy chain dimer IgG in a camelid does not have to make hydrophobic interactions with a light chain, the region in the heavy chain that normally contacts a light chain is changed to hydrophilic amino acid residues in a camelid. $V_H$ domains of heavy-chain dimer IgGs are called $V_{HH}$ domains.

In camelids, the diversity of antibody repertoire is determined by the complementary determining regions (CDR) 1, 2, and 3 in the $V_H$ or $V_{HH}$ regions. The CDR3 in the camel $V_{HH}$ region is characterized by its relatively long length averaging 16 amino acids (Muyldermans et al., 1994, Protein Engineering 7(9): 1129). This is in contrast to CDR3 regions of antibodies of many other species. For example, the CDR3 of mouse $V_H$ has an average of 9 amino acids.

Libraries of camelid-derived antibody variable regions, which maintain the in vivo diversity of the variable regions of a camelid, can be made by, for example, the methods disclosed in U.S. Patent Application Ser. No. 20050037421, published Feb. 17, 2005.

As used herein, "HA," "NB," and "NA" respectively mean hemagglutinin, NB protein and neuraminidase. HA, NB and NA are antigenic glycoproteins located on the surface of influenza viruses. These glycoproteins are responsible for the binding the virus to the cell that is to be infected and processes that result in infection with the virus.

As used herein, the term "naturally occurring" means that the components are encoded by a single gene that was not altered by recombinant means and that pre-exists in an organism, e.g., in an antibody library that was created from naive cells or cells that were exposed to an antigen.

As used herein, the term "antigen" refers to substances that are capable, under appropriate conditions, of inducing a specific immune response and of reacting with the products of that response, such as, with specific antibodies or specifically sensitized T-lymphocytes, or both. Antigens may be soluble substances, such as toxins and foreign proteins, or particulates, such as bacteria and tissue cells; however, only the portion of the protein or polysaccharide molecule known as the antigenic determinant (epitopes) combines with the antibody or a specific receptor on a lymphocyte. More broadly, the term "antigen" may be used to refer to any substance to which an antibody binds, or for which antibodies are desired, regardless of whether the substance is immunogenic. For such antigens, antibodies may be identified by recombinant methods, independently of any immune response.

As used herein, the term "epitope" refers to the site on an antigen or hapten to which specific B cells and/or T cells respond. The term is also used interchangeably with "antigenic determinant" or "antigenic determinant site". Epitopes include that portion of an antigen or other macromolecule capable of forming a binding interaction that interacts with the variable region binding pocket of an antibody.

As used herein, the term "binding specificity" of an antibody refers to the identity of the antigen to which the antibody binds, preferably to the identity of the epitope to which the antibody binds.

As used herein, the term "chimeric polynucleotide" means that the polynucleotide comprises regions which are wild-type and regions which are mutated. It may also mean that the polynucleotide comprises wild-type regions from one polynucleotide and wild-type regions from another related polynucleotide.

As used herein, the term "chimeric polynucleotide" means that the polynucleotide comprises regions which are wild-type and regions which are mutated. It may also mean that the polynucleotide comprises wild-type regions from one polynucleotide and wild-type regions from another related polynucleotide.

As used herein, the term "complementarity-determining region" or "CDR" refer to the art-recognized term as exemplified by the Kabat and Chothia. CDRs are also generally known as hypervariable regions or hypervariable loops (Chothia and Lesk (1987) J Mol. Biol. 196: 901; Chothia et al. (1989) Nature 342: 877; E. A. Kabat et al., Sequences of Proteins of Immunological Interest (National Institutes of Health, Bethesda, Md.) (1987); and Tramontano et al. (1990) J Mol. Biol. 215: 175). "Framework region" or "FR" refers to the region of the V domain that flank the CDRs. The positions of the CDRs and framework regions can be determined using various well known definitions in the art, e.g., Kabat, Chothia, international ImMunoGeneTics database (IMGT), and AbM (see, e.g., Johnson et al., supra; Chothia & Lesk, 1987, Canonical structures for the hypervariable regions of immunoglobulins. J. Mol. Biol. 196, 901-917; Chothia C. et al., 1989, Conformations of immunoglobulin hypervariable regions. Nature 342, 877-883; Chothia C. et al., 1992, structural repertoire of the human $V_H$ segments J. Mol. Biol. 227, 799-817; Al-Lazikani et al., J. Mol. Biol 1997, 273(4)). Definitions of antigen combining sites are also described in the following: Ruiz et al., IMGT, the international ImMunoGeneTics database. Nucleic Acids Res., 28, 219-221 (2000); and Lefranc, M.-P. IMGT, the international ImMunoGeneTics database. Nucleic Acids Res. January 1; 29(1):207-9 (2001); MacCallum et al, Antibody-antigen interactions: Contact analysis and binding site topography, J. Mol. Biol., 262 (5), 732-745 (1996); and Martin et al, Proc. Natl Acad. Sci. USA, 86, 9268-9272 (1989); Martin, et al, Methods Enzymol., 203, 121-153, (1991); Pedersen et al, Immunomethods, 1, 126, (1992); and Rees et al, In Sternberg M. J. E. (ed.), Protein Structure Prediction. Oxford University Press, Oxford, 141-172 1996).

The term "conservative substitution" refers to substitution of an amino acid in a polypeptide with a functionally, structurally or chemically similar natural or unnatural amino acid. In certain embodiments, the following groups each contain natural amino acids that are conservative substitutions for one another:

1) Glycine (Gly/G), Alanine (Ala/A);
2) Isoleucine (Ile/I), Leucine (Leu/L), Methionine (Met/M), Valine (Val/V);
3) Phenylalanine (Phe/F), Tyrosine (Tyr/Y), Tryptophan (Trp/W);
4) Serine (Ser/S), Threonine (Thr/T), Cysteine (Cys/C);
5) Asparagine (Asn/N), Glutamine (Gln/Q);
6) Aspartic acid (Asp/D), Glutamic acid (Glu/E); and
7) Arginine (Arg/R), Lysine (Lys/K), Histidine (His/H).

As used herein, the term "hapten" is a small molecule that, when attached to a larger carrier such as a protein, can elicit an immune response in an organism, e.g., such as the production of antibodies that bind specifically to it (in either the free or combined state). A "hapten" is able to bind to a preformed antibody, but may fail to stimulate antibody generation on its own. In the context of this invention, the term "hapten" includes modified amino acids, either naturally occurring or non-naturally occurring. Thus, for example, the term "hapten" includes naturally occurring modified amino acids such as phosphotyrosine, phosphothreonine, phosphoserine, or sulphated residues such as sulphated tyrosine (sulphotyrosine), sulphated serine (sulphoserine), or sulphated threonine (sulphothreonine); and also include non-naturally occurring modified amino acids such as p-nitro-phenylalanine.

As used herein, the term "heterologous" when used with reference to portions of a polynucleotide indicates that the nucleic acid comprises two or more subsequences that are not normally found in the same relationship to each other in nature. For instance, the nucleic acid is typically recombinantly produced, having two or more sequences, e.g., from unrelated genes arranged to make a new functional nucleic acid. Similarly, a "heterologous" polypeptide or protein refers to two or more subsequences that are not found in the same relationship to each other in nature.

As used herein, the term "host cell" refers to a prokaryotic or eukaryotic cell into which the vectors of the invention may be introduced, expressed and/or propagated. A microbial host cell is a cell of a prokaryotic or eukaryotic micro-organism, including bacteria, yeasts, microscopic fungi and microscopic phases in the life-cycle of fungi and slime molds. Typical prokaryotic host cells include various strains of *E. coli*. Typical eukaryotic host cells are yeast or filamentous fungi, or mammalian cells, such as Chinese hamster ovary cells, murine NIH 3T3 fibroblasts, human embryonic kidney 193 cells, or rodent myeloma or hybridoma cells.

As used herein, the term "immunological response" to a composition or vaccine is the development in the host of a cellular and/or antibody-mediated immune response to a composition or vaccine of interest. Usually, an "immunological response" includes but is not limited to one or more of the following effects: the production of antibodies, B cells, helper T cells, and/or cytotoxic T cells, directed specifically to an antigen or antigens included in the composition or vaccine of interest. Preferably, the host will display either a therapeutic or protective immunological response such that resistance to new infection will be enhanced and/or the clinical severity of the disease reduced. Such protection will be demonstrated by either a reduction or lack of symptoms normally displayed by an infected host, a quicker recovery time and/or a lowered viral titer in the infected host.

As used herein, the term "isolated" refers to a nucleic acid or polypeptide separated not only from other nucleic acids or polypeptides that are present in the natural source of the nucleic acid or polypeptide, but also from polypeptides, and preferably refers to a nucleic acid or polypeptide found in the presence of (if anything) only a solvent, buffer, ion, or other component normally present in a solution of the same. The terms "isolated" and "purified" do not encompass nucleic acids or polypeptides present in their natural source.

As used herein, the term "mammal" refers to warm-blooded vertebrate animals all of which possess hair and suckle their young.

As used herein, "percentage of sequence identity" and "percentage homology" are used interchangeably herein to refer to comparisons among polynucleotides or polypeptides, and are determined by comparing two optimally aligned sequences over a comparison window, where the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, *Adv Appl Math.* 2:482, 1981; by the homology alignment algorithm of Needleman and Wunsch, *J Mol Biol.* 48:443, 1970; by the search for similarity method of Pearson and Lipman, *Proc Natl Acad Sci. USA* 85:2444, 1988; by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Greene Publishing Associates, Inc. and John Wiley & Sons, Inc., (1995 Supplement). Examples of algorithms that are suitable for determining percent sequence identity and sequence similarity are the BLAST and BLAST 2.0 algorithms, which are described in Altschul et al., *J. Mol. Biol.* 215:403-410, 1990; and Altschul et al., *Nucleic Acids Res.* 25(17):3389-3402, 1977; respectively. Software for performing BLAST analyses is publicly available through the National Center for Biotechnology Information website. BLAST for nucleotide sequences can use the BLASTN program with default parameters, e.g., a wordlength (W) of 11, an expectation (E) of 10, M=5, N=−4, and a comparison of both strands. BLAST for amino acid sequences can use the BLASTP program with default parameters, e.g., a wordlength (W) of 3, an expectation (E) of 10, and the BLOSUM62 scoring matrix (see Henikoff and Henikoff, *Proc Natl Acad Sci. USA* 89:10915, 1989). Exemplary determination of sequence alignment and % sequence identity can also employ the BESTFIT or GAP programs in the GCG Wisconsin Software package (Accelrys, Madison WI), using default parameters provided.

The term "pharmaceutically acceptable" refers to a substance (e.g., an active ingredient or an excipient) that is suitable for use in contact with the tissues and organs of a subject without excessive irritation, allergic response, immunogenicity and toxicity, is commensurate with a reasonable benefit/risk ratio, and is effective for its intended use. A "pharmaceutically acceptable" excipient or carrier of a pharmaceutical composition is also compatible with the other ingredients of the composition.

As used herein, the terms "protein", "peptide", "polypeptide" and "polypeptide fragment" are used interchangeably herein to refer to polymers of amino acid residues of any length. The polymer can be linear or branched, it may comprise modified amino acids or amino acid analogs, and it may be interrupted by chemical moieties other than amino acids. The terms also encompass an amino acid polymer that has been modified naturally or by intervention; for example disulfide bond formation, glycosylation, lipidation, acetylation, phosphorylation, or any other manipulation or modification, such as conjugation with a labeling or bioactive component.

As used herein, the term "protracting moiety" means a molecule that can be attached to a polypeptide (e.g., an antibody light and/or heavy chain) to increase its molecular weight so that the polypeptide's residence time in the blood (and/or serum) is increased. For example, the protracting moiety can increase the serum/blood half-life of the polypeptide. The increased half-life or residence time can be the result of, for example, reduced glomerular filtration by the kidney, and/or reduced uptake by the liver, and/or reduced binding and removal by immune binding proteins, etc. A protracting moiety can be, for example, another polypeptide, a polymer (e.g., synthetic polymer, natural polymer, etc.), etc.

As used herein, the term "purified" means that the indicated nucleic acid or polypeptide is present in the substantial absence of other biological macromolecules, e.g., polynucleotides, proteins, and the like. In one embodiment, the polynucleotide or polypeptide is purified such that it constitutes at least 95% by weight, more preferably at least 99.8% by weight, of the indicated biological macromolecules present (but water, buffers, and other small molecules, especially molecules having a molecular weight of less than 1000 daltons, can be present).

As used herein, the terms "RBD", "S1", "S2", "EP", and "MP" mean, respectively, SARS-CoV-2 receptor binding domain (RBD), SARS-CoV-2 Spike 1 protein (S1), SARS-CoV-2 Spike 2 protein (S2), SARS-CoV-2 Envelope Proteins (EP), and SARS-CoV-2 Membrane Protein (MP).

As used herein, the term "recombinant nucleic acid" refers to a nucleic acid in a form not normally found in nature. That is, a recombinant nucleic acid is flanked by a nucleotide sequence not naturally flanking the nucleic acid or has a sequence not normally found in nature. Recombinant nucleic acids can be originally formed in vitro by the manipulation of nucleic acid by restriction endonucleases, or alternatively using such techniques as polymerase chain reaction. It is understood that once a recombinant nucleic acid is made and reintroduced into a host cell or organism, it will replicate non-recombinantly, i.e., using the in vivo cellular machinery of the host cell rather than in vitro manipulations; however, such nucleic acids, once produced recombinantly, although subsequently replicated non-recombinantly, are still considered recombinant for the purposes of the invention.

As used herein, the term "recombinant polypeptide" refers to a polypeptide expressed from a recombinant nucleic acid, or a polypeptide that is chemically synthesized in vitro.

As used herein, the term "recombinant variant" refers to any polypeptide differing from naturally occurring polypeptides by amino acid insertions, deletions, and substitutions, created using recombinant DNA techniques. Guidance in determining which amino acid residues may be replaced, added, or deleted without abolishing activities of interest, such as enzymatic or binding activities, may be found by comparing the sequence of the particular polypeptide with that of homologous peptides and minimizing the number of amino acid sequence changes made in regions of high homology.

Preferably, amino acid "substitutions" are the result of replacing one amino acid with another amino acid having similar structural and/or chemical properties, i.e., conservative amino acid replacements. Amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid.

As used herein, the term "SARS-CoV-2" means the Severe acute respiratory syndrome coronavirus 2 that cause the illness COVID-19. SARS-CoV-2 includes the strains and sub-strains of coronavirus that are arising during this outbreak of SARS-CoV-2.

The term "stringent hybridization conditions" refers to hybridizing in 50% formamide at 5×SSC at a temperature of 42° C. and washing the filters in 0.2×SSC at 60° C. (1×SSC is 0.15M NaCl, sodium citrate.) Stringent hybridization conditions also encompasses low ionic strength and high temperature for washing, for example 0.015 M sodium chloride/0.0015 M sodium citrate/0.1% sodium dodecyl sulfate at 50° C.; hybridization with a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in (sodium chloride/sodium citrate) and 50% formamide at 55° C., followed by a high-stringency wash consisting of 0.1×SSC containing EDTA at 55° C.

The term "substantially homologous" or "substantially identical" in the context of two polypeptides or polynucleotides refers to two or more sequences or subsequences that have at least about 50%, 60%, 65%, 70%, 75%, 80%, 85%, 90%, 95%, 96%, 97%, 98% or 99% amino acid or nucleic acid residue identity, when compared and aligned for maximum correspondence, as measured using a sequence comparison algorithm or by visual inspection. The terms "substantially homologous" or "substantially identical" can mean at least about 70% amino acid or nucleic acid residue identity. The term "substantially homologous" or "substantially identical" can mean at least about 85% amino acid or nucleic acid residue identity. The substantial homology or identity can exist over a region of the sequences that is at least about 20, 30, 40, 50, 100, 150 or 200 residues in length. The sequences can be substantially homologous or identical over the entire length of either or both comparison biopolymers.

Optimal alignment of sequences for comparison can be conducted, e.g., by the local homology algorithm of Smith and Waterman, *Adv. Appl. Math.,* 2:482 (1981); by the homology alignment algorithm of Needleman and Wunsch, *J. Mol. Biol.,* 48:443 (1970); by the search for similarity method of Pearson and Lipman, *Proc. Natl. Acad. Sci. USA,* 85:2444 (1988); by computerized implementations of these algorithms (e.g., GAP, BESTFIT, FASTA, and TFASTA in the Wisconsin Genetics Software Package, Genetics Computer Group, Madison, Wisconsin); or by visual inspection.

One example of a useful algorithm is PILEUP. PILEUP creates a multiple sequence alignment from a group of related sequences using progressive, pairwise alignments to show relationship and percent sequence identity. It also plots a tree or dendogram showing the clustering relationships used to create the alignment. PILEUP uses a simplification of the progressive alignment method of Feng and Doolittle, J. Mol. Evol., 35:351-360 (1987). The method used is similar to the method described by Higgins and Sharp, CABIOS, 5:151-153 (1989). The program can align up to about 300 sequences, each having a maximum length of about 5,000 nucleotides or amino acids. The multiple alignment procedure begins with the pairwise alignment of the two most similar sequences, producing a cluster of two aligned sequences. This cluster is then aligned to the next most related sequence or cluster of aligned sequences. Two clusters of sequences are aligned by a simple extension of the pairwise alignment of two individual sequences. The final alignment is achieved by a series of progressive, pairwise alignments. The program is run by designating specific sequences and their amino acid or nucleotide coordinates for regions of sequence comparison and by designating the program parameters. For example, a reference sequence can be compared to other test sequences to determine the percent sequence identity relationship using the following parameters: default gap weight (3.00), default gap length weight (0.10), and weighted end gaps. Another algorithm that is useful for generating multiple alignments of sequences is Clustal W (see, e.g., Thompson et al., Nucleic Acids Research, 22:4673-4680 [1994]).

Another example of an algorithm that is suitable for determining percent sequence identity and sequence similarity is the BLAST algorithm, which is described in Altschul et al., J. Mol. Biol., 215:403-410 (1990). Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction is halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults, e.g., a wordlength (W) of 11, an expectation (E) of 10, M=5, N=−4, and a comparison of both strands. For amino acid sequences, the BLASTP program uses as defaults, e.g., a wordlength (W) of 3, an expectation (E) of 10, and the BLOSUM62 scoring matrix (see Henikoff and Henikoff, Proc. Natl. Acad. Sci. USA, 89:10915 [1989]).

In addition to calculating percent sequence identity, the BLAST algorithm also performs a statistical analysis of the similarity between two sequences (see, e.g., Karlin and Altschul, Proc. Natl. Acad. Sci. USA, 90:5873-5787 [1993]). One measure of similarity provided by the BLAST algorithm is the smallest sum probability [P(N)], which provides an indication of the probability by which a match between two nucleotide or amino acid sequences would occur by chance. In certain embodiments, a polynucleotide is considered similar to a reference sequence if the smallest sum probability in a comparison of the test polynucleotide to the reference polynucleotide is less than about 0.1, 0.01 or 0.001.

A polypeptide can be substantially homologous or identical to a second polypeptide if the two polypeptides differ only by conservative amino acid substitutions. Two nucleic acid sequences can be substantially homologous or identical if the two polynucleotides hybridize to each other under stringent conditions, or under highly stringent conditions, as described herein.

The term "therapeutically effective amount" refers to an amount of a compound that, when administered to a subject, is sufficient to prevent, reduce the risk of developing, delay the onset of, slow the progression or cause regression of the medical condition being treated, or to alleviate to some extent the medical condition or one or more symptoms or complications of that condition. The term "therapeutically effective amount" also refers to an amount of a compound that is sufficient to elicit the biological or medical response of a cell, tissue, organ, system, animal or human which is sought by a researcher, veterinarian, medical doctor or clinician.

The singular terms "a", "an", and "the" include plural referents unless context clearly indicates otherwise. Similarly, the word "or" is intended to include "and" unless the context clearly indicates otherwise. Numerical limitations given with respect to concentrations or levels of a substance, such as an antigen, are intended to be approximate. Thus, where a concentration is indicated to be at least (for example) 200 μg, it is intended that the concentration be understood to be at least approximately "about" or "about" 200 μg.

Anti-SARS-CoV-2 Antibodies

Antibodies are immune binding proteins that are structurally defined as comprising an amino acid sequence recognized as being derived from the framework region of an immunoglobulin. An antibody can consist of one or more polypeptides substantially encoded by immunoglobulin genes or fragments of immunoglobulin genes. The immunoglobulin genes can include, for example, the kappa, lambda, alpha, gamma, delta, epsilon and mu constant region genes, as well as myriad immunoglobulin variable region genes. Antibody light chains can be classified as either kappa or lambda. Antibody heavy chains can be classified as gamma, mu, alpha, delta, or epsilon, which in turn can define the immunoglobulin classes, IgG, IgM, IgA, IgD and IgE, respectively.

Antibodies can exist as intact immunoglobulins or as a number of well-known fragments. Pepsin digests an antibody below the disulfide linkages in the hinge region and can produce $F(ab)'_2$, a dimer of Fab which itself is a light chain joined to VH-CH1 by a disulfide bond. The $F(ab)'_2$ may be reduced under mild conditions to break the disulfide linkage in the hinge region thereby converting the (Fab') 2 dimer into Fab' monomers. The Fab' monomer can be an Fab with part of the hinge region (see, Fundamental Immunology, W. E. Paul, ed., Raven Press, N.Y. (1993), which is incorporated by reference in its entirety for all purposes). Antibody fragments can also be synthesized de novo either chemically or by utilizing recombinant DNA methodology. Antibodies can include $V_H$-$V_L$ dimers, including single chain antibodies (antibodies that exist as a single polypeptide chain), diabodies, or single chain Fv antibodies (sFv or scFv) in which a variable heavy and a variable light region are joined together (directly or through a peptide linker) to form a continuous polypeptide. (e.g., Huston, et al. Proc. Nat. Acad. Sci. USA, 85:5879-5883, 1988, which is incorporated by reference in its entirety for all purposes). Antibodies can also include other fragments, including, for example, Fab molecules displayed on phage if one of the chains (heavy or light) is fused to g3 capsid protein and the complementary chain exported to the periplasm as a soluble molecule. (e.g., U.S. Pat. No. 5,733,743, which is incorporated by reference in its entirety for all purposes). The antibody can be an scFv antibody or a number of other structures converting the naturally aggregated, but chemically separated light and heavy polypeptide chains from an antibody V region into a molecule that folds into a three dimensional structure substantially similar to the structure of an antigen-binding site are known to those of skill in the art (e.g., U.S. Pat. Nos. 5,091,513, 5,132,405, and 4,956,778, which are all incorporated by reference in their entirety for all purposes). The scFv can be a diabody as described in Holliger et al., Proc. Nat'l Acad. Sci. vol. 90, pp. 6444-6448 (1993), which is incorporated by reference in its entirety for all purposes. Antibodies include all those that have been displayed on phage or generated by recombinant technology using vectors where the chains are secreted as soluble proteins, e.g., scFv, Fv, Fab, pr $(Fab')_2$. Antibodies can also include miniantibodies. The antibody can be obtained from a B-cell, a plasma cell, a B memory cell, a pre-B-cell or a progenitor B-cell.

The antibodies can be monoclonal, and can be fully human antibodies, chimeric antibodies, or CDR-grafted antibodies. The antibodies can be full length or and antibody fragment. Antibody fragments include any of the well-known formats or types, including for example, antigen-binding fragments (Fab), single chain variable fragments (scFv) and "third generation" (3G). Nelson, MAbs 2010, 2:77-83, doi: 10.4161/mabs.2.1.10786, which is incorporated by reference in its entirety for all purposes. F(ab')2, Fab, Fab' and Fv are examples of antigen-binding fragments that can be generated from the variable region of IgG and IgM.

Anti-SARS-CoV-2 antibody 3417 can have a variable region comprised of a heavy chain with the amino acid sequence of:

(SEQ ID NO: 1)
MYRMQLLSCIALSLALVTNSQVQLQESGPGLLKPSQTLSLTCTVSGVSIR

NSNYFWNWIRRPAGKGLEWIGRMHSGGTTNYNPSLKSRVTVSSDAARNQF

SLELTSVTAADTAVYYCARDDPLNRFAAFQIWGRGTLVTVSSASTKGPSV

FPLAPSSKSTSGGTAALGCLVKDYFPEPVTVSWNSGALTSGVHTFPAVLQ

SSGLYSLSSVVTVPSSSLGTQTYICNVNHKPSNTKVDKKVEPKSCDKTHT

CPPCPAPELLGGPSVFLFPPKPKDTLMISRTPEVTCVVVDVSHEDPEVKF

NWYVDGVEVHNAKTKPREEQYNSTYRVVSVLTVLHQDWLNGKEYKCKVSN

KALPAPIEKTISKAKGQPREPQVYTLPPSREEMTKNQVSLTCLVKGFYPS

DIAVEWESNGQPENNYKTTPPVLDSDGSFFLYSKLTVDKSRWQQGNVFSC

SVMHEALHNHYTQKSLSLSPGK

This heavy chain amino acid sequence can be encoded in a nucleic acid sequence of:

(SEQ ID NO: 2)
ATGTACAGGATGCAACTCCTGTCTTGCATTGCACTAAGTCTTGCACTTGT

CACGAATTCGCAGGTGCAGCTGCAGGAGTCGGGCCCAGGACTGCTGAAGC

CCTCGCAGACCCTGTCCCTCACCTGCACTGTCTCTGGTGTCTCCATCAGA

AATAGTAATTACTTCTGGAATTGGATCCGGCGGCCCGCCGGGAAGGGACT

-continued

GGAGTGGATTGGGCGTATGCATAGTGGTGGGACCACCAATTACAATCCCT

CCCTCAAGAGTCGGGTCACCGTGTCAAGTGACGCGGCCAGGAACCAGTTC

TCCCTGGAGTTGACCTCTGTGACCGCCGCAGACACGGCCGTGTATTACTG

TGCGAGAGATGACCCCCTTAACCGGTTCGCTGCTTTTCAAATCTGGGGCC

GAGGGACACTGGTCACCGTCTCTTCAGCTAGCACCAAGGGCCCATCGGTC

TTCCCCCTGGCACCCTCCTCCAAGAGCACCTCTGGGGGCACAGCGGCCCT

GGGCTGCCTGGTCAAGGACTACTTCCCCGAACCGGTGACGGTGTCGTGGA

ACTCAGGCGCCCTGACCAGCGGCGTGCACACCTTCCCGGCTGTCCTACAG

TCCTCAGGACTCTACTCCCTCAGCAGCGTGGTGACCGTGCCCTCCAGCAG

CTTGGGCACCCAGACCTACATCTGCAACGTGAATCACAAGCCCAGCAACA

CCAAGGTGGACAAGAAAGTTGAGCCCAAATCTTGTGACAAAACTCACACA

TGCCCACCGTGCCCAGCACCTGAACTCCTGGGGGGACCGTCAGTCTTCCT

CTTCCCCCCAAAACCCAAGGACACCCTCATGATCTCCCGGACCCCTGAGG

TCACATGCGTGGTGGTGGACGTGAGCCACGAAGACCCTGAGGTCAAGTTC

AACTGGTACGTGGACGGCGTGGAGGTGCATAATGCCAAGACAAAGCCGCG

GGAGGAGCAGTACAACAGCACGTACCGTGTGGTCAGCGTCCTCACCGTCC

TGCACCAGGACTGGCTGAATGGCAAGGAGTACAAGTGCAAGGTCTCCAAC

AAAGCCCTCCCAGCCCCCATCGAGAAAACCATCTCCAAAGCCAAAGGGCA

GCCCCGAGAACCACAGGTGTACACCCTGCCCCCATCCCGGGAGGAGATGA

CCAAGAACCAGGTCAGCCTGACCTGCCTGGTCAAAGGCTTCTATCCCAGC

GACATCGCCGTGGAGTGGGAGAGCAATGGGCAGCCGGAGAACAACTACAA

GACCACGCCTCCCGTGCTGGACTCCGACGGCTCCTTCTTCCTCTACAGCA

AGCTCACCGTGGACAAGAGCAGGTGGCAGCAGGGGAACGTCTTCTCATGC

TCCGTGATGCATGAGGCTCTGCACAACCACTACACGCAGAAGAGCCTCTC

CCTGTCTCCGGGTAAATGA

Anti-SARS-CoV-2 antibody 3417 can have a variable region comprised of a light chain with the amino acid sequence of:

(SEQ ID NO: 3)
MYRMQLLSCIALSLALVTNSQSVLTQPPSVSAAPGQKVTISCSGSSSNIG

NKYISWYQQLPGTAPKLLIYDNNKRPSGIPDRFSGSKSGTSATLGITGLQ

TGDEADYYCGTWDSSLSVFYVFGTGTKVTVLGQPKAAPSVTLFPPSSEEL

QANKATLVCLISDFYPGAVTVAWKADSSPVKAGVETTTPSKQSNNKYAAS

SYLSLTPEQWKSHRSYSCQVTHEGSTVEKTVAPTECS

This light chain amino acid sequence can be encoded in a nucleic acid sequence of:

(SEQ ID NO: 4)
ATGTACAGGATGCAACTCCTGTCTTGCATTGCACTAAGTCTTGCACTTGT

CACGAATTCGCAGTCTGTGTTGACGCAGCCGCCCTCAGTGTCTGCGGCCC

CAGGACAGAAGGTCACCATCTCCTGCTCTGGAAGCAGCTCCAACATTGGG

AATAAATATATATCCTGGTACCAGCAGCTCCCAGGAACAGCCCCCAAACT

-continued

CCTCATTTATGACAATAATAAGCGACCCTCAGGGATTCCTGACCGATTCT

CTGGCTCCAAGTCTGGCACGTCAGCCACCCTGGGCATCACCGGACTCCAG

ACTGGGGACGAGGCCGATTATTACTGCGGAACATGGGATAGCAGCCTGAG

TGTTTTTATGTCTTCGGAACTGGGACCAAGGTCACCGTCCTGGGTCAGC

CCAAGGCTGCCCCCTCGGTCACTCTGTTCCCGCCCTCCTCTGAGGAGCTT

CAAGCCAACAAGGCCACACTGGTGTGTCTCATAAGTGACTTCTACCCGGG

AGCCGTGACAGTGGCCTGGAAGGCAGATAGCAGCCCCGTCAAGGCGGGAG

TGGAGACCACCACACCCTCCAAACAAAGCAACAACAAGTACGCGGCCAGC

AGCTATCTGAGCCTGACGCCTGAGCAGTGGAAGTCCCACAGAAGCTACAG

CTGCCAGGTCACGCATGAAGGGAGCACCGTGGAGAAGACAGTGGCCCCTA

CAGAATGTTCATAG

Anti-SARS-CoV-2 antibody 3387 can have a variable region comprised of a heavy chain with the amino acid sequence of:

(SEQ ID NO: 5)

MYRMQLLSCIALSLALVTNSQVQLVQSGAEVMQVGASVKVSCKASGYTFT

SYGISWVRQAPGQGLEWMGWINTYNGNTNYAQKLQGRVTMTTDTSTTTAY

MELRSLRSDDTAVYYCARVAVGYCSGGSCYYFDYWGQGTLVTVSSASTKG

PSVFPLAPSSKSTSGGTAALGCLVKDYFPEPVTVSWNSGALTSGVHTFPA

VLQSSGLYSLSSVVTVPSSSLGTQTYICNVNHKPSNTKVDKKVEPKSCDK

THTCPPCPAPELLGGPSVFLFPPKPKDTLMISRTPEVTCVVVDVSHEDPE

VKFNWYVDGVEVHNAKTKPREEQYNSTYRVVSVLTVLHQDWLNGKEYKCK

VSNKALPAPIEKTISKAKGQPREPQVYTLPPSREEMTKNQVSLTCLVKGF

YPSDIAVEWESNGQPENNYKTTPPVLDSDGSFFLYSKLTVDKSRWQQGNV

FSCSVMHEALHNHYTQKSLSLSPGK

This heavy chain amino acid sequence can be encoded in a nucleic acid sequence of:

(SEQ ID NO: 6)

ATGTACAGGATGCAACTCCTGTCTTGCATTGCACTAAGTCTTGCACTTGT

CACGAATTCGCAGGTTCAGCTGGTGCAGTCTGGAGCTGAGGTGATGCAAG

TGGGGGCCTCAGTGAAGGTCTCCTGCAAGGCTTCTGGTTACACCTTTACC

AGCTATGGTATCAGCTGGGTGCGACAGGCCCCCGGACAAGGGCTTGAGTG

GATGGGATGGATCAACACTTACAATGGTAACACAAACTATGCACAGAAGC

TCCAGGGCAGAGTCACCATGACCACAGACACATCCACGACCACAGCCTAC

ATGGAGCTGAGGAGCCTGAGATCTGACGACACGGCCGTGTATTACTGTGC

GAGAGTCGCTGTAGGATATTGCAGTGGTGGTAGCTGCTACTACTTTGACT

ACTGGGGCCAGGGAACCCTGGTCACCGTCTCCTCAGCTAGCACCAAGGGC

CCATCGGTCTTCCCCCTGGCACCCTCCTCCAAGAGCACCTCTGGGGGCAC

AGCGGCCCTGGGCTGCCTGGTCAAGGACTACTTCCCCGAACCGGTGACGG

TGTCGTGGAACTCAGGCGCCCTGACCAGCGGCGTGCACACCTTCCCGGCT

GTCCTACAGTCCTCAGGACTCTACTCCCTCAGCAGCGTGGTGACCGTGCC

-continued

CTCCAGCAGCTTGGGCACCCAGACCTACATCTGCAACGTGAATCACAAGC

CCAGCAACACCAAGGTGGACAAGAAAGTTGAGCCCAAATCTTGTGACAAA

ACTCACACATGCCCACCGTGCCCAGCACCTGAACTCCTGGGGGGACCGTC

AGTCTTCCTCTTCCCCCCAAAACCCAAGGACACCCTCATGATCTCCCGGA

CCCCTGAGGTCACATGCGTGGTGGTGGACGTGAGCCACGAAGACCCTGAG

GTCAAGTTCAACTGGTACGTGGACGGCGTGGAGGTGCATAATGCCAAGAC

AAAGCCGCGGGAGGAGCAGTACAACAGCACGTACCGTGTGGTCAGCGTCC

TCACCGTCCTGCACCAGGACTGGCTGAATGGCAAGGAGTACAAGTGCAAG

GTCTCCAACAAAGCCCTCCCAGCCCCCATCGAGAAAACCATCTCCAAAGC

CAAAGGGCAGCCCCGAGAACCACAGGTGTACACCCTGCCCCCATCCCGGG

AGGAGATGACCAAGAACCAGGTCAGCCTGACCTGCCTGGTCAAAGGCTTC

TATCCCAGCGACATCGCCGTGGAGTGGGAGAGCAATGGGCAGCCGGAGAA

CAACTACAAGACCACGCCTCCCGTGCTGGACTCCGACGGCTCCTTCTTCC

TCTACAGCAAGCTCACCGTGGACAAGAGCAGGTGGCAGCAGGGGAACGTC

TTCTCATGCTCCGTGATGCATGAGGCTCTGCACAACCACTACACGCAGAA

GAGCCTCTCCCTGTCTCCGGGTAAATGA.

Anti-SARS-CoV-2 antibody 3387 can have a variable region comprised of a light chain with the amino acid sequence of:

(SEQ ID NO: 7)

MYRMQLLSCIALSLALVTNSPEIVMTQSPATLSVSPGERATLSCRASQSV

SNNLAWYQQKPGQAPRLLIYGASTRATGIPARFSGSGSGTEFTLTISSLQ

SEDFAVYYCQQYNDWPPSWTFGQGTKVEIKRTVAAPSVFIFPPSDEQLKS

GTASVVCLLNNFYPREAKVQWKVDNALQSGNSQESVTEQDSKDSTYSLSS

TLTLSKADYEKHKVYACEVTHQGLSSPVTKSFNRGEC

This light chain amino acid sequence can be encoded in a nucleic acid sequence of:

(SEQ ID NO: 8)

ATGTACAGGATGCAACTCCTGTCTTGCATTGCACTAAGTCTTGCACTTGT

CACGAATTCACCGGAAATAGTGATGACGCAGTCTCCAGCCACCCTGTCTG

TGTCTCCAGGGGAAAGAGCCACCCTCTCCTGCAGGGCCAGTCAGAGTGTT

AGCAACAACTTAGCCTGGTACCAGCAGAAACCTGGCCAGGCTCCCAGGCT

CCTCATCTATGGTGCATCCACCAGGGCCACTGGTATCCCAGCCAGGTTCA

GTGGCAGTGGGTCTGGAACAGAGTTCACTCTCACCATCAGCAGCCTGCAG

TCTGAAGATTTTGCAGTTTATTACTGTCAGCAGTATAATGACTGGCCTCC

GTCTTGGACGTTCGGCCAAGGGACCAAGGTGGAAATCAAACGTACGGTGG

CTGCACCATCTGTCTTCATCTTCCCGCCATCTGATGAGCAGTTGAAATCT

GGAACTGCCTCTGTTGTGTGCCTGCTGAATAACTTCTATCCCAGAGAGGC

CAAAGTACAGTGGAAGGTGGATAACGCCCTCCAATCGGGTAACTCCCAGG

-continued

AGAGTGTCACAGAGCAGGACAGCAAGGACAGCACCTACAGCCTCAGCAGC

ACCCTGACGCTGAGCAAAGCAGACTACGAGAAACACAAAGTCTACGCCTG

CGAAGTCACCCATCAGGGCCTGAGCTCGCCCGTCACAAAGAGCTTCAACA

GGGGAGAGTGTTAG

Anti-SARS-CoV-2 antibody 3705 is a single chain antibody with the amino acid sequence of:

(SEQ ID NO: 9)
MKYLLPTAAAGLLLLAAQPAMALEIVMTQSPATLSVSPGERATLSCRASQ

SVSNNLAWYQQKPGQAPRLLIYGASTRATGIPARFSGSGSGTEFTLTISS

LQSEDFAVYYCQQYNDWPPSWTFGQGTKVEIKGGGGSGGGGSGGGGSQVQ

LVQSGAEVMQVGASVKVSCKASGYTFTSYGISWVRQAPGQGLEWMGWINT

YNGNTNYAQKLQGRVTMTTDTSTTTAYMELRSLRSDDTAVYYCARVAVGY

CSGGSCYYFDYWGQGTLVTVSSGGGGSGGQHHHHHHGAEQKLISEEDLGS

GKPIPNPLLGLDSTS

This amino acid sequence can be encoded in a nucleic acid sequence of:

(SEQ ID NO: 10)
ATGAAATACCTATTGCCTACGGCGGCCGCTGGATTGTTATTACTCGCGGC

CCAGCCGGCCATGGCATTAGAAATAGTGATGACGCAGTCTCCAGCCACCC

TGTCTGTGTCTCCAGGGGAAAGAGCCACCCTCTCCTGCAGGGCCAGTCAG

AGTGTTAGCAACAACTTAGCCTGGTACCAGCAGAAACCTGGCCAGGCTCC

CAGGCTCCTCATCTATGGTGCATCCACCAGGGCCACTGGTATCCCAGCCA

GGTTCAGTGGCAGTGGGTCTGGAACAGAGTTCACTCTCACCATCAGCAGC

CTGCAGTCTGAAGATTTTGCAGTTTATTACTGTCAGCAGTATAATGACTG

GCCTCCGTCTTGGACGTTCGGCCAAGGGACCAAGGTGGAAATCAAAGGAG

GAGGAGGCTCTGGGGGCGGCGGTTCTGGAGGAGGTGGAAGTcaggtgcag ctggttcagtctggcgccgaagtgatgcaagtgggggcatcagtgaaggt gtcctgtaaggcttccggttatacctttaccagctatggaatctcgtggg tgcggcaggcccctggacaagggcttgagtggatgggatggattaatact tacaatgggaacacaaactatgcacagaaactccagggcagagtaaccat gactactgacacatccacgaccacagcctacatggagctgaggagcttac gatctgatgacacggccgtttattactgtgcgcgcgtcgctgtaggctat tgcagtggtggcagctgctactacttcgattactggggccagggaacatt ggtcaccgtcagttcaGGAGGCGGTGGTTCAGGTGGACAACACCATCACC

ACCATCATGGCGCAGAACAAAAACTCATCTCAGAAGAGGATCTGGGTAGT

GGCAAGCCGATCCCGAATCCTCTGCTGGGATTAGACTCCACATCTTAA

Anti-SARS-CoV-2 antibody 3388 can have a variable region comprised of a heavy chain with the amino acid sequence of:

(SEQ ID NO: 11)
MYRMQLLSCIALSLALVTNSQVQLVESGGGVVQPGRSLRLSCAASGFTFS

SYAMHWVRQAPGKGLEWVAVISYDGSNKYYADSVKGRFTISRDNSKNTLY

LQMNSLRAEDTAVYYCAREGNIVATISLDWWGQGTLVTVSSASTKGPSVF

PLAPSSKSTSGGTAALGCLVKDYFPEPVTVSWNSGALTSGVHTFPAVLQS

SGLYSLSSVVTVPSSSLGTQTYICNVNHKPSNTKVDKKVEPKSCDKTHTC

PPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNK

ALPAPIEKTISKAKGQPREPQVYTLPPSREEMTKNQVSLTCLVKGFYPSD

IAVEWESNGQPENNYKTTPPVLDSDGSFFLYSKLTVDKSRWQQGNVFSCS

VMHEALHNHYTQKSLSLSPGK

This heavy chain amino acid sequence can be encoded in a nucleic acid sequence of:

(SEQ ID NO: 12)
ATGTACAGGATGCAACTCCTGTCTTGCATTGCACTAAGTCTTGCACTTGT

CACGAATTCGCAGGTGCAGCTGGTGGAGTCTGGGGGAGGCGTGGTCCAGC

CTGGGAGGTCCCTGAGACTCTCCTGTGCAGCCTCTGGATTCACCTTCAGT

AGCTATGCTATGCACTGGGTCCGCCAGGCTCCAGGCAAGGGGCTGGAGTG

GGTGGCAGTTATATCATATGATGGAAGTAATAAATACTACGCAGACTCCG

TGAAGGGCCGATTCACCATCTCCAGAGACAATTCCAAGAACACGCTGTAT

CTGCAAATGAACAGCCTGAGAGCTGAGGACACGGCTGTGTATTACTGTGC

GAGAGAAGGGAATATAGTGGCTACGATTTCTCTGGACTACTGGGGCCAGG

GAACCCTGGTCACCGTCTCCTCAGCTAGCACCAAGGGCCCATCGGTCTTC

CCCCTGGCACCCTCCTCCAAGAGCACCTCTGGGGGCACAGCGGCCCTGGG

CTGCCTGGTCAAGGACTACTTCCCCGAACCGGTGACGGTGTCGTGGAACT

CAGGCGCCCTGACCAGCGGCGTGCACACCTTCCCGGCTGTCCTACAGTCC

TCAGGACTCTACTCCCTCAGCAGCGTGGTGACCGTGCCCTCCAGCAGCTT

GGGCACCCAGACCTACATCTGCAACGTGAATCACAAGCCCAGCAACACCA

AGGTGGACAAGAAAGTTGAGCCCAAATCTTGTGACAAAACTCACACATGC

CCACCGTGCCCAGCACCTGAACTCCTGGGGGGACCGTCAGTCTTCCTCTT

CCCCCCAAAACCCAAGGACACCCTCATGATCTCCCGGACCCCTGAGGTCA

CATGCGTGGTGGTGGACGTGAGCCACGAAGACCCTGAGGTCAAGTTCAAC

TGGTACGTGGACGGCGTGGAGGTGCATAATGCCAAGACAAAGCCGCGGGA

GGAGCAGTACAACAGCACGTACCGTGTGGTCAGCGTCCTCACCGTCCTGC

ACCAGGACTGGCTGAATGGCAAGGAGTACAAGTGCAAGGTCTCCAACAAA

GCCCTCCCAGCCCCCATCGAGAAAACCATCTCCAAAGCCAAAGGGCAGCC

CCGAGAACCACAGGTGTACACCCTGCCCCCATCCCGGGAGGAGATGACCA

AGAACCAGGTCAGCCTGACCTGCCTGGTCAAAGGCTTCTATCCCAGCGAC

ATCGCCGTGGAGTGGGAGAGCAATGGGCAGCCGGAGAACAACTACAAGAC

-continued

CACGCCTCCCGTGCTGGACTCCGACGGCTCCTTCTTCCTCTACAGCAAGC

TCACCGTGGACAAGAGCAGGTGGCAGCAGGGGAACGTCTTCTCATGCTCC

GTGATGCATGAGGCTCTGCACAACCACTACACGCAGAAGAGCCTCTCCCT

GTCTCCGGGTAAATGA

Anti-SARS-CoV-2 antibody 3388 can have a variable region comprised of a light chain with the amino acid sequence of:

(SEQ ID NO: 13)
MYRMQLLSCIALSLALVTNSQSVLTQPPSVSGAPGQRVTISCTGSSSNIG

AGYDVHWYQQLPGTAPKLLIYGNSNRPSGVPDRFSGSKSGTSASLAITGL

QAEDEADYYCQSYDSSLSVVFGGGTKLTVLGQPKAAPSVTLFPPSSEELQ

ANKATLVCLISDFYPGAVTVAWKADSSPVKAGVETTTPSKQSNNKYAASS

YLSLTPEQWKSHRSYSCQVTHEGSTVEKTVAPTECS

This light chain amino acid sequence can be encoded in a nucleic acid sequence of:

(SEQ ID NO: 14)
ATGTACAGGATGCAACTCCTGTCTTGCATTGCACTAAGTCTTGCACTTGT

CACGAATTCGCAGTCTGTGCTGACGCAGCCGCCCTCAGTGTCTGGGGCCC

CAGGGCAGAGGGTCACCATCTCCTGCACTGGGAGCAGCTCCAACATCGGG

GCAGGTTATGATGTACACTGGTACCAGCAGCTTCCAGGAACAGCCCCCAA

ACTCCTCATCTATGGTAACAGCAATCGGCCCTCAGGGGTCCCTGACCGAT

TCTCTGGCTCCAAGTCTGGCACCTCAGCCTCCCTGGCCATCACTGGGCTC

CAGGCTGAGGATGAGGCTGATTATTACTGCCAGTCCTATGACAGCAGCCT

GAGTGTGGTATTCGGCGGAGGGACCAAGCTGACCGTCCTAGGTCAGCCCA

AGGCTGCCCCCTCGGTCACTCTGTTCCCGCCCTCCTCTGAGGAGCTTCAA

GCCAACAAGGCCACACTGGTGTGTCTCATAAGTGACTTCTACCCGGGAGC

CGTGACAGTGGCCTGGAAGGCAGATAGCAGCCCCGTCAAGGCGGGAGTGG

AGACCACCACACCCTCCAAACAAAGCAACAACAAGTACGCGGCCAGCAGC

TATCTGAGCCTGACGCCTGAGCAGTGGAAGTCCCACAGAAGCTACAGCTG

CCAGGTCACGCATGAAGGGAGCACCGTGGAGAAGACAGTGGCCCCTACAG

AATGTTCATAG

Anti-SARS-CoV-2 antibody 3396 can have a variable region comprised of a heavy chain with the amino acid sequence of:

(SEQ ID NO: 15)
MYRMQLLSCIALSLALVTNSGVQLVESGGGLVQPGRSLRVSCAASGFTFA

DYAMEIWVRQAPGKGLEWVSGISWNSGNIAYADSVKGRFTISRDNAKNSL

YLQMDSLRPDDTALYYCVKASTLYYYFYMDVWGKGTTVTVSSASTKGPSV

FPLAPSSKSTSGGTAALGCLVKDYFPEPVTVSWNSGALTSGVHTFPAVLQ

SSGLYSLSSVVTVPSSSLGTQTYICNVNHKPSNTKVDKKVEPKSCDKTHT

CPPCPAPELLGGPSVFLFPPKPKDTLMISRTPEVTCVVVDVSHEDPEVKF

NWYVDGVEVHNAKTKPREEQYNSTYRVVSVLTVLHQDWLNGKEYKCKVSN

-continued

KALPAPIEKTISKAKGQPREPQVYTLPPSREEMTKNQVSLTCLVKGFYPS

DIAVEWESNGQPENNYKTTPPVLDSDGSFFLYSKLTVDKSRWQQGNVFSC

SVMHEALHNHYTQKSLSLSPGK

This heavy chain amino acid sequence can be encoded in a nucleic acid sequence of:

(SEQ ID NO: 16)
ATGTACAGGATGCAACTCCTGTCTTGCATTGCACTAAGTCTTGCACTTGT

CACGAATTCGGGAGTGCAGCTGGTGGAGTCTGGGGGAGGCTTGGTACAGC

CTGGCAGGTCCCTGAGAGTCTCCTGTGCAGCCTCTGGATTCACCTTTGCT

GATTACGCCATGCACTGGGTCCGGCAAGCTCCAGGGAAGGGCCTGGAGTG

GGTCTCAGGAATCAGTTGGAATAGTGGTAACATAGCCTATGCGGACTCTG

TGAAGGGCCGATTCACCATCTCCAGAGACAACGCCAAGAACTCCCTGTAT

CTTCAAATGGACAGTCTGAGACCTGATGACACGGCCCTGTATTATTGTGT

AAAGGCCTCAACCCTCTACTACTATTTCTACATGGATGTCTGGGGCAAAG

GGACCACGGTCACCGTTTCCTCAGCTAGCACCAAGGGCCCATCGGTCTTC

CCCCTGGCACCCTCCTCCAAGAGCACCTCTGGGGGCACAGCGGCCCTGGG

CTGCCTGGTCAAGGACTACTTCCCCGAACCGGTGACGGTGTCGTGGAACT

CAGGCGCCCTGACCAGCGGCGTGCACACCTTCCCGGCTGTCCTACAGTCC

TCAGGACTCTACTCCCTCAGCAGCGTGGTGACCGTGCCCTCCAGCAGCTT

GGGCACCCAGACCTACATCTGCAACGTGAATCACAAGCCCAGCAACACCA

AGGTGGACAAGAAAGTTGAGCCCAAATCTTGTGACAAAACTCACACATGC

CCACCGTGCCCAGCACCTGAACTCCTGGGGGGACCGTCAGTCTTCCTCTT

CCCCCCAAAACCCAAGGACACCCTCATGATCTCCCGGACCCCTGAGGTCA

CATGCGTGGTGGTGGACGTGAGCCACGAAGACCCTGAGGTCAAGTTCAAC

TGGTACGTGGACGGCGTGGAGGTGCATAATGCCAAGACAAAGCCGCGGGA

GGAGCAGTACAACAGCACGTACCGTGTGGTCAGCGTCCTCACCGTCCTGC

ACCAGGACTGGCTGAATGGCAAGGAGTACAAGTGCAAGGTCTCCAACAAA

GCCCTCCCAGCCCCCATCGAGAAAACCATCTCCAAAGCCAAAGGGCAGCC

CCGAGAACCACAGGTGTACACCCTGCCCCCATCCCGGGAGGAGATGACCA

AGAACCAGGTCAGCCTGACCTGCCTGGTCAAAGGCTTCTATCCCAGCGAC

ATCGCCGTGGAGTGGGAGAGCAATGGGCAGCCGGAGAACAACTACAAGAC

CACGCCTCCCGTGCTGGACTCCGACGGCTCCTTCTTCCTCTACAGCAAGC

TCACCGTGGACAAGAGCAGGTGGCAGCAGGGGAACGTCTTCTCATGCTCC

GTGATGCATGAGGCTCTGCACAACCACTACACGCAGAAGAGCCTCTCCCT

GTCTCCGGGTAAATGA

Anti-SARS-CoV-2 antibody 3396 can have a variable region comprised of a light chain with the amino acid sequence of:

(SEQ ID NO: 17)
MYRMQLLSCIALSLALVTNSQSALTQPPSASGSPGQSVTISCTGTSSDVG

GYDYVSWYQQHPGKAPKFMIYEVSKRPSGVPDRFSGSKSGNTASLTVSGL

QAEDEADYYCCSYAGSNNYVFGTGTKVTVLGQPKAAPSVTLFPPSSEELQ

-continued

ANKATLVCLISDFYPGAVTVAWKADSSPVKAGVETTTPSKQSNNKYAASS

YLSLTPEQWKSHRSYSCQVTHEGSTVEKTVAPTECS

This light chain amino acid sequence can be encoded in a nucleic acid sequence of:

(SEQ ID NO: 18)
ATGTACAGGATGCAACTCCTGTCTTGCATTGCACTAAGTCTTGCACTTGT

CACGAATTCGCAGTCTGCCCTGACTCAGCCTCCCTCCGCGTCCGGGTCTC

CTGGACAGTCAGTCACCATCTCCTGCACTGGAACCAGCAGTGACGTTGGT

GGTTATGACTATGTCTCCTGGTACCAACAGCACCCAGGCAAAGCCCCCAA

ATTCATGATTTATGAGGTCAGTAAGCGGCCCTCAGGGGTCCCTGATCGCT

TCTCTGGCTCCAAGTCTGGCAACACGGCCTCCCTGACCGTCTCTGGGCTC

CAGGCTGAGGATGAGGCTGATTATTACTGCTGCTCATATGCAGGCAGCAA

CAATTATGTCTTCGGAACTGGGACCAAGGTCACCGTCCTAGGTCAGCCCA

AGGCTGCCCCCTCGGTCACTCTGTTCCCGCCCTCCTCTGAGGAGCTTCAA

GCCAACAAGGCCACACTGGTGTGTCTCATAAGTGACTTCTACCCGGGAGC

CGTGACAGTGGCCTGGAAGGCAGATAGCAGCCCCGTCAAGGCGGGAGTGG

AGACCACCACACCCTCCAAACAAAGCAACAACAAGTACGCGGCCAGCAGC

TATCTGAGCCTGACGCCTGAGCAGTGGAAGTCCCACAGAAGCTACAGCTG

CCAGGTCACGCATGAAGGGAGCACCGTGGAGAAGACAGTGGCCCCTACAG

AATGTTCATAG

Anti-SARS-CoV-2 antibody 3908 can have a variable region comprised of a heavy chain with the amino acid sequence of:

(SEQ ID NO: 19)
MYRMQLLSCIALSLALVTNSEVQLVESRGGLVQPGGSLRLSCAATGFTLS

SFDMHWVRQATGKGLEWVSAIGTAGDTYYPGSVKGRFTISRENAKNSLYL

QMNSLRAGDTAVYYCARGTWLRDYNFWSGYNYYFDYWGQGTLVTVSSAST

KGPSVFPLAPSSKSTSGGTAALGCLVKDYFPEPVTVSWNSGALTSGVHTF

PAVLQSSGLYSLSSVVTVPSSSLGTQTYICNVNHKPSNTKVDKKVEPKSC

DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSREEMTKNQVSLTCLVK

GFYPSDIAVEWESNGQPENNYKTTPPVLDSDGSFFLYSKLTVDKSRWQQG

NVFSCSVMHEALHNHYTQKSLSLSPGK

This heavy chain amino acid sequence can be encoded in a nucleic acid sequence of:

(SEQ ID NO: 20)
ATGTACAGGATGCAACTCCTGTCTTGCATTGCACTAAGTCTTGCACTTGT

CACGAATTCGGAGGTGCAGCTGGTGGAGTCTAGGGGAGGCTTGGTACAGC

CTGGGGGGTCCCTGAGACTCTCCTGTGCAGCCACTGGATTCACCCTCAGT

AGCTTCGACATGCACTGGGTCCGCCAAGCTACAGGAAAAGGTCTGGAGTG

-continued

GGTCTCAGCTATTGGTACTGCTGGTGACACATACTATCCAGGCTCCGTGA

AGGGCCGATTCACCATCTCCAGAGAAAATGCCAAGAACTCCTTGTATCTT

CAAATGAACAGCCTGAGAGCCGGGGACACGGCTGTGTATTACTGTGCAAG

AGGGACCTGGCTCCGAGATTACAATTTTTGGAGTGGTTATAATTACTACT

TTGACTACTGGGGCCAGGGAACCCTGGTCACCGTCTCCTCAGCTAGCACC

AAGGGCCCATCGGTCTTCCCCCTGGCACCCTCCTCCAAGAGCACCTCTGG

GGGCACAGCGGCCCTGGGCTGCCTGGTCAAGGACTACTTCCCCGAACCGG

TGACGGTGTCGTGGAACTCAGGCGCCCTGACCAGCGGCGTGCACACCTTC

CCGGCTGTCCTACAGTCCTCAGGACTCTACTCCCTCAGCAGCGTGGTGAC

CGTGCCCTCCAGCAGCTTGGGCACCCAGACCTACATCTGCAACGTGAATC

ACAAGCCCAGCAACACCAAGGTGGACAAGAAAGTTGAGCCCAAATCTTGT

GACAAAACTCACACATGCCCACCGTGCCCAGCACCTGAACTCCTGGGGGG

ACCGTCAGTCTTCCTCTTCCCCCCAAAACCCAAGGACACCCTCATGATCT

CCCGGACCCCTGAGGTCACATGCGTGGTGGTGGACGTGAGCCACGAAGAC

CCTGAGGTCAAGTTCAACTGGTACGTGGACGGCGTGGAGGTGCATAATGC

CAAGACAAAGCCGCGGGAGGAGCAGTACAACAGCACGTACCGTGTGGTCA

GCGTCCTCACCGTCCTGCACCAGGACTGGCTGAATGGCAAGGAGTACAAG

TGCAAGGTCTCCAACAAAGCCCTCCCAGCCCCCATCGAGAAAACCATCTC

CAAAGCCAAAGGGCAGCCCCGAGAACCACAGGTGTACACCCTGCCCCCAT

CCCGGGAGGAGATGACCAAGAACCAGGTCAGCCTGACCTGCCTGGTCAAA

GGCTTCTATCCCAGCGACATCGCCGTGGAGTGGGAGAGCAATGGGCAGCC

GGAGAACAACTACAAGACCACGCCTCCCGTGCTGGACTCCGACGGCTCCT

TCTTCCTCTACAGCAAGCTCACCGTGGACAAGAGCAGGTGGCAGCAGGGG

AACGTCTTCTCATGCTCCGTGATGCATGAGGCTCTGCACAACCACTACAC

GCAGAAGAGCCTCTCCCTGTCTCCGGGTAAATGA

Anti-SARS-CoV-2 antibody 3908 can have a variable region comprised of a light chain with the amino acid sequence of:

(SEQ ID NO: 21)
MYRIVIQLLSCIALSLALVTNSQSALTQPPSASGSPGQSVTISCTGTSSD

VGGYIYVSWYQQHPGKAPKLIIYEVSKRPSGVPDRFSGSKSGNTASLTVS

GLQAEDEADYYCSSYADSNNYVFGSGTRVTVLGQPKAAPSVTLFPPSSEE

LQANKATLVCLISDFYPGAVTVAWKADSSPVKAGVETTTPSKQSNNKYAA

SSYLSLTPEQWKSHRSYSCQVTHEGSTVEKTVAPTECS

This light chain amino acid sequence can be encoded in a nucleic acid sequence of:

(SEQ ID NO: 22)
ATGTACAGGATGCAACTCCTGTCTTGCATTGCACTAAGTCTTGCACTTGT

CACGAATTCGCAGTCTGCCCTGACTCAGCCTCCCTCCGCGTCCGGGTCTC

CTGGACAGTCAGTCACCATCTCCTGCACTGGAACCAGCAGTGACGTTGGT

GGTTATATCTATGTCTCCTGGTACCAACAACACCCAGGCAAAGCCCCCAA

ACTCATCATTTATGAGGTCAGTAAGCGGCCCTCAGGGGTCCCTGATCGCT

TCTCTGGCTCCAAGTCTGGCAACACGGCCTCCCTGACCGTCTCTGGGCTC

CAGGCTGAAGATGAGGCTGATTATTATTGCAGCTCATATGCAGACAGCAA

CAATTATGTCTTCGGAAGTGGGACCAGGGTCACCGTCCTAGGTCAGCCCA

AGGCTGCCCCCTCGGTCACTCTGTTCCCGCCCTCCTCTGAGGAGCTTCAA

GCCAACAAGGCCACACTGGTGTGTCTCATAAGTGACTTCTACCCGGGAGC

CGTGACAGTGGCCTGGAAGGCAGATAGCAGCCCCGTCAAGGCGGGAGTGG

AGACCACCACACCCTCCAAACAAAGCAACAACAAGTACGCGGCCAGCAGC

TATCTGAGCCTGACGCCTGAGCAGTGGAAGTCCCACAGAAGCTACAGCTG

CCAGGTCACGCATGAAGGGAGCACCGTGGAGAAGACAGTGGCCCCTACAG

AATGTTCATAG

Anti-SARS-CoV-2 antibody 3916 can have a variable region comprised of a heavy chain with the amino acid sequence of:

(SEQ ID NO: 23)

MYRMQLLSCIALSLALVTNSQVQLQQWGAGLLKPSETLSLTCAVYGGSFS

GYYWSWIRQPPGKGLEWIGEINHSGSTNYNPSLKSRVTISVDTSKNQFSL

KLSSVTAADTAVYYCARQRGQRITMVRLKRDWFDPWGQGTLVTVSSASTK

GPSVFPLAPSSKSTSGGTAALGCLVKDYFPEPVTVSWNSGALTSGVHTFP

AVLQSSGLYSLSSVVTVPSSSLGTQTYICNVNHKPSNTKVDKKVEPKSCD

KTHTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYKC

KVSNKALPAPIEKTISKAKGQPREPQVYTLPPSREEMTKNQVSLTCLVKG

FYPSDIAVEWESNGQPENNYKTTPPVLDSDGSFFLYSKLTVDKSRWQQGN

VFSCSVMHEALHNHYTQKSLSLSPGK

This heavy chain amino acid sequence can be encoded in a nucleic acid sequence of:

(SEQ ID NO: 24)

ATGTACAGGATGCAACTCCTGTCTTGCATTGCACTAAGTCTTGCACTTG

TCACGAATTCGCAGGTGCAGCTACAGCAGTGGGGCGCAGGACTGTTGAA

GCCTTCGGAGACCCTGTCCCTCACCTGCGCTGTCTATGGTGGGTCCTTC

AGTGGTTACTACTGGAGCTGGATCCGCCAGCCCCCAGGGAAGGGGCTGG

AGTGGATTGGGGAAATCAATCATAGTGGAAGCACCAACTACAACCCGTC

CCTCAAGAGTCGAGTCACCATATCAGTAGACACGTCCAAGAACCAGTTC

TCCCTGAAGCTGAGCTCTGTGACCGCCGCGGACACGGCTGTGTATTACT

GTGCGAGGCAAAGGGGGCAACGTATTACTATGGTTCGGCTAAAACGGGA

CTGGTTCGACCCCTGGGGCCAGGGAACCCTGGTCACCGTCTCCTCAGCT

AGCACCAAGGGCCCATCGGTCTTCCCCCTGGCACCCTCCTCCAAGAGCA

CCTCTGGGGGCACAGCGGCCCTGGGCTGCCTGGTCAAGGACTACTTCCC

CGAACCGGTGACGGTGTCGTGGAACTCAGGCGCCCTGACCAGCGGCGTG

CACACCTTCCCGGCTGTCCTACAGTCCTCAGGACTCTACTCCCTCAGCA

GCGTGGTGACCGTGCCCTCCAGCAGCTTGGGCACCCAGACCTACATCTG

-continued

CAACGTGAATCACAAGCCCAGCAACACCAAGGTGGACAAGAAAGTTGAG

CCCAAATCTTGTGACAAAACTCACACATGCCCACCGTGCCCAGCACCTG

AACTCCTGGGGGGACCGTCAGTCTTCCTCTTCCCCCCAAAACCCAAGGA

CACCCTCATGATCTCCCGGACCCCTGAGGTCACATGCGTGGTGGTGGAC

GTGAGCCACGAAGACCCTGAGGTCAAGTTCAACTGGTACGTGGACGGCG

TGGAGGTGCATAATGCCAAGACAAAGCCGCGGGAGGAGCAGTACAACAG

CACGTACCGTGTGGTCAGCGTCCTCACCGTCCTGCACCAGGACTGGCTG

AATGGCAAGGAGTACAAGTGCAAGGTCTCCAACAAAGCCCTCCCAGCCC

CCATCGAGAAAACCATCTCCAAAGCCAAAGGGCAGCCCCGAGAACCACA

GGTGTACACCCTGCCCCCATCCCGGGAGGAGATGACCAAGAACCAGGTC

AGCCTGACCTGCCTGGTCAAAGGCTTCTATCCCAGCGACATCGCCGTGG

AGTGGGAGAGCAATGGGCAGCCGGAGAACAACTACAAGACCACGCCTCC

CGTGCTGGACTCCGACGGCTCCTTCTTCCTCTACAGCAAGCTCACCGTG

GACAAGAGCAGGTGGCAGCAGGGGAACGTCTTCTCATGCTCCGTGATGC

ATGAGGCTCTGCACAACCACTACACGCAGAAGAGCCTCTCCCTGTCTCC

GGGTAAATGA

Anti-SARS-CoV-2 antibody 3916 can have a variable region comprised of a light chain with the amino acid sequence of:

(SEQ ID NO: 25)

MYRMQLLSCIALSLALVTNSQSVLTQPPSASGTPGQRVTISCSGSSSNI

GSNTVNWYQQLPGTAPKLLIYSNNQRPSGVPDRFSGSKSGTSASLAISG

LQSEDEADYYCAAWDDSLNGPVFGGGTKLTVLGQPKAAPSVTLFPPSSE

ELQANKATLVCLISDFYPGAVTVAWKADSSPVKAGVETTTPSKQSNNKY

AASSYLSLTPEQWKSHRSYSCQVTHEGSTVEKTVAPTECS

This light chain amino acid sequence can be encoded in a nucleic acid sequence of:

(SEQ ID NO: 26)

ATGTACAGGATGCAACTCCTGTCTTGCATTGCACTAAGTCTTGCACTTG

TCACGAATTCGCAGTCTGTGCTGACTCAGCCACCCTCAGCGTCTGGGAC

CCCCGGGCAGAGGGTCACCATCTCTTGTTCTGGAAGCAGCTCCAACATC

GGAAGTAATACTGTAAACTGGTACCAGCAGCTCCCAGGAACGGCCCCCA

AACTCCTCATCTATAGTAATAATCAGCGGCCCTCAGGGGTCCCTGACCG

ATTCTCTGGCTCCAAGTCTGGCACCTCAGCCTCCCTGGCCATCAGTGGG

CTCCAGTCTGAGGATGAGGCTGATTATTACTGTGCAGCATGGGATGACA

GCCTGAATGGTCCTGTATTCGGCGGAGGGACCAAGCTGACCGTCCTAGG

TCAGCCCAAGGCTGCCCCCTCGGTCACTCTGTTCCCGCCCTCCTCTGAG

GAGCTTCAAGCCAACAAGGCCACACTGGTGTGTCTCATAAGTGACTTCT

ACCCGGGAGCCGTGACAGTGGCCTGGAAGGCAGATAGCAGCCCCGTCAA

GGCGGGAGTGGAGACCACCACACCCTCCAAACAAAGCAACAACAAGTAC

GCGGCCAGCAGCTATCTGAGCCTGACGCCTGAGCAGTGGAAGTCCCACA

-continued

GAAGCTACAGCTGCCAGGTCACGCATGAAGGGAGCACCGTGGAGAAGAC

AGTGGCCCCTACAGAATGTTCATAG

Anti-SARS-CoV-2 antibody 3929 can have a variable region comprised of a heavy chain with the amino acid sequence of:

(SEQ ID NO: 27)

MYRMQLLSCIALSLALVTNSQVQLVQSGAEVMTVGASVKVSCKASGYTF

TSYGISWVRQAPGQGLEWMGWINTYNGNTNYAQKLQGRVTMTTDTSTTT

AYMELRSLRSDDTAVYYCARVAVGYCSGGSCYYFDYWGQGTLVTVSSAS

TKGPSVFPLAPSSKSTSGGTAALGCLVKDYFPEPVTVSWNSGALTSGVH

TFPAVLQSSGLYSLSSVVTVPSSSLGTQTYICNVNHKPSNTKVDKKVEP

KSCDKTHTCPPCPAPELLGGPSVFLFPPKPKDTLMISRTPEVTCVVVDV

SHEDPEVKFNWYVDGVEVHNAKTKPREEQYNSTYRVVSVLTVLHQDWLN

GKEYKCKVSNKALPAPIEKTISKAKGQPREPQVYTLPPSREEMTKNQVS

LTCLVKGFYPSDIAVEWESNGQPENNYKTTPPVLDSDGSFFLYSKLTVD

KSRWQQGNVFSCSVMHEALHNHYTQKSLSLSPGK

This heavy chain amino acid sequence can be encoded in a nucleic acid sequence of:

(SEQ ID NO: 28)

ATGTACAGGATGCAACTCCTGTCTTGCATTGCACTAAGTCTTGCACTTG

TCACGAATTCGCAGGTTCAGCTGGTGCAGTCTGGAGCTGAGGTGATGAC

AGTGGGGGCCTCAGTGAAGGTCTCCTGCAAGGCTTCTGGTTACACCTTT

ACCAGCTATGGTATCAGCTGGGTGCGACAGGCCCCCGGACAAGGGCTTG

AGTGGATGGGATGGATCAACACTTACAATGGTAACACAAACTATGCACA

GAAGCTCCAGGGCAGAGTCACCATGACCACAGACACATCCACGACCACA

GCCTACATGGAGCTGAGGAGCCTGAGATCTGACGACACGGCCGTGTATT

ACTGTGCGAGAGTCGCTGTAGGATATTGCAGTGGTGGTAGCTGCTACTA

CTTTGACTACTGGGGCCAGGGAACCCTGGTCACCGTCTCCTCAGCTAGC

ACCAAGGGCCCATCGGTCTTCCCCCTGGCACCCTCCTCCAAGAGCACCT

CTGGGGGCACAGCGGCCCTGGGCTGCCTGGTCAAGGACTACTTCCCCGA

ACCGGTGACGGTGTCGTGGAACTCAGGCGCCCTGACCAGCGGCGTGCAC

ACCTTCCCGGCTGTCCTACAGTCCTCAGGACTCTACTCCCTCAGCAGCG

TGGTGACCGTGCCCTCCAGCAGCTTGGGCACCCAGACCTACATCTGCAA

CGTGAATCACAAGCCCAGCAACACCAAGGTGGACAAGAAAGTTGAGCCC

AAATCTTGTGACAAAACTCACACATGCCCACCGTGCCCAGCACCTGAAC

TCCTGGGGGGACCGTCAGTCTTCCTCTTCCCCCCAAAACCCAAGGACAC

CCTCATGATCTCCCGGACCCCTGAGGTCACATGCGTGGTGGTGGACGTG

AGCCACGAAGACCCTGAGGTCAAGTTCAACTGGTACGTGGACGGCGTGG

AGGTGCATAATGCCAAGACAAAGCCGCGGGAGGAGCAGTACAACAGCAC

GTACCGTGTGGTCAGCGTCCTCACCGTCCTGCACCAGGACTGGCTGAAT

GGCAAGGAGTACAAGTGCAAGGTCTCCAACAAAGCCCTCCCAGCCCCCA

-continued

TCGAGAAAACCATCTCCAAAGCCAAAGGGCAGCCCCGAGAACCACAGGT

GTACACCCTGCCCCCATCCCGGGAGGAGATGACCAAGAACCAGGTCAGC

CTGACCTGCCTGGTCAAAGGCTTCTATCCCAGCGACATCGCCGTGGAGT

GGGAGAGCAATGGGCAGCCGGAGAACAACTACAAGACCACGCCTCCCGT

GCTGGACTCCGACGGCTCCTTCTTCCTCTACAGCAAGCTCACCGTGGAC

AAGAGCAGGTGGCAGCAGGGGAACGTCTTCTCATGCTCCGTGATGCATG

AGGCTCTGCACAACCACTACACGCAGAAGAGCCTCTCCCTGTCTCCGGG

TAAATGA

Anti-SARS-CoV-2 antibody 3929 can have a variable region comprised of a light chain with the amino acid sequence of:

(SEQ ID NO: 29)

MYRMQLLSCIALSLALVTNSQSVLTQPPSASGTPGQRVTISCSGSSSNM

GSNFVYWYQHLPGTAPKLLIQRNNQRPSGVPDRFSGSKSGTSASLAISG

LRSEDEADYYCAAWDDSLNGVVFGGGTALTVLGQPKAAPSVTLFPPSSE

ELQANKATLVCLISDFYPGAVTVAWKADSSPVKAGVETTTPSKQSNNKY

AASSYLSLTPEQWKSHRSYSCQVTHEGSTVEKTVAPTECS

This light chain amino acid sequence can be encoded in a nucleic acid sequence of:

(SEQ ID NO: 30)

ATGTACAGGATGCAACTCCTGTCTTGCATTGCACTAAGTCTTGCACTTG

TCACGAATTCGCAGTCTGTGCTGACTCAGCCACCCTCAGCGTCTGGGAC

CCCCGGGCAGAGGGTCACCATCTCTTGTTCTGGAAGCAGTTCCAATATG

GGAAGTAATTTTGTATACTGGTACCAGCACCTCCCAGGAACGGCCCCCA

AACTCCTCATCCAAAGAAATAATCAGCGGCCCTCAGGGGTCCCTGACCG

ATTCTCTGGCTCCAAGTCTGGCACCTCAGCCTCCCTGGCCATCAGTGGG

CTCCGGTCCGAGGATGAGGCTGATTACTACTGTGCAGCATGGGATGACA

GCCTGAATGGTGTGGTCTTCGGCGGAGGGACCGCGCTGACCGTCCTAGG

TCAGCCCAAGGCTGCCCCCTCGGTCACTCTGTTCCCGCCCTCCTCTGAG

GAGCTTCAAGCCAACAAGGCCACACTGGTGTGTCTCATAAGTGACTTCT

ACCCGGGAGCCGTGACAGTGGCCTGGAAGGCAGATAGCAGCCCCGTCAA

GGCGGGAGTGGAGACCACCACACCCTCCAAACAAAGCAACAACAAGTAC

GCGGCCAGCAGCTATCTGAGCCTGACGCCTGAGCAGTGGAAGTCCCACA

GAAGCTACAGCTGCCAGGTCACGCATGAAGGGAGCACCGTGGAGAAGAC

AGTGGCCCCTACAGAATGTTCATAG

Anti-SARS-CoV-2 antibody 3940 can have a variable region comprised of a heavy chain with the amino acid sequence of:

(SEQ ID NO: 31)

MYRMQLLSCIALSLALVTNSEVQLVQSGAEVKKPGESLKISCKGSGYSF

TSYWIGWVRQMPGKGLEWMGIIYPGDSDTRYSPSFQGQVTISADKSIST

AYLQWSSLKASDTAMYYCARGDCSSTSCYLDYWGQGTLVTVSSASTKGP

SVFPLAPSSKSTSGGTAALGCLVKDYFPEPVTVSWNSGALTSGVHTFPA

-continued

VLQSSGLYSLSSVVTVPSSSLGTQTYICNVNHKPSNTKVDKKVEPKSCD

KTHTCPPCPAPELLGGPSVFLEPPKPKDTLMISRTPEVTCVVVDVSHED

PEVKFNWYVDGVEVHNAKTKPREEQYNSTYRVVSVLTVLHQDWLNGKEY

KCKVSNKALPAPIEKTISKAKGQPREPQVYTLPPSREEMTKNQVSLTCL

VKGFYPSDIAVEWESNGQPENNYKTTPPVLDSDGSFFLYSKLTVDKSRW

QQGNVFSCSVMHEALHNHYTQKSLSLSPGK

This heavy chain amino acid sequence can be encoded in a nucleic acid sequence of:

(SEQ ID NO: 32)

ATGTACAGGATGCAACTCCTGTCTTGCATTGCACTAAGTCTTGCACTTGT

CACGAATTCGGAGGTGCAGCTGGTGCAGTCTGGAGCAGAGGTGAAAAAGC

CCGGGGAGTCTCTGAAGATCTCCTGTAAGGGTTCTGGATACAGCTTTACC

AGCTACTGGATCGGCTGGGTGCGCCAGATGCCCGGGAAAGGCCTGGAGTG

GATGGGGATCATCTATCCTGGTGACTCTGATACCAGATACAGCCCGTCCT

TCCAAGGCCAGGTCACCATCTCAGCCGACAAGTCCATCAGCACCGCCTAC

CTGCAGTGGAGCAGCCTGAAGGCCTCGGACACCGCCATGTATTACTGTGC

GAGGGGCGATTGTAGTAGTACCAGCTGCTACCTTGACTACTGGGGCCAGG

GAACCCTGGTCACCGTCTCCTCAGCTAGCACCAAGGGCCCATCGGTCTTC

CCCCTGGCACCCTCCTCCAAGAGCACCTCTGGGGGCACAGCGGCCCTGGG

CTGCCTGGTCAAGGACTACTTCCCCGAACCGGTGACGGTGTCGTGGAACT

CAGGCGCCCTGACCAGCGGCGTGCACACCTTCCCGGCTGTCCTACAGTCC

TCAGGACTCTACTCCCTCAGCAGCGTGGTGACCGTGCCCTCCAGCAGCTT

GGGCACCCAGACCTACATCTGCAACGTGAATCACAAGCCCAGCAACACCA

AGGTGGACAAGAAAGTTGAGCCCAAATCTTGTGACAAAACTCACACATGC

CCACCGTGCCCAGCACCTGAACTCCTGGGGGGACCGTCAGTCTTCCTCTT

CCCCCCAAAACCCAAGGACACCCTCATGATCTCCCGGACCCCTGAGGTCA

CATGCGTGGTGGTGGACGTGAGCCACGAAGACCCTGAGGTCAAGTTCAAC

TGGTACGTGGACGGCGTGGAGGTGCATAATGCCAAGACAAAGCCGCGGGA

GGAGCAGTACAACAGCACGTACCGTGTGGTCAGCGTCCTCACCGTCCTGC

ACCAGGACTGGCTGAATGGCAAGGAGTACAAGTGCAAGGTCTCCAACAAA

GCCCTCCCAGCCCCCATCGAGAAAACCATCTCCAAAGCCAAAGGGCAGCC

CCGAGAACCACAGGTGTACACCCTGCCCCCATCCCGGGAGGAGATGACCA

AGAACCAGGTCAGCCTGACCTGCCTGGTCAAAGGCTTCTATCCCAGCGAC

ATCGCCGTGGAGTGGGAGAGCAATGGGCAGCCGGAGAACAACTACAAGAC

CACGCCTCCCGTGCTGGACTCCGACGGCTCCTTCTTCCTCTACAGCAAGC

TCACCGTGGACAAGAGCAGGTGGCAGCAGGGGAACGTCTTCTCATGCTCC

GTGATGCATGAGGCTCTGCACAACCACTACACGCAGAAGAGCCTCTCCCT

GTCTCCGGGTAAATGA

Anti-SARS-CoV-2 antibody 3940 can have a variable region comprised of a light chain with the amino acid sequence of:

(SEQ ID NO: 33)

MYRMQLLSCIALSLALVTNSHSEQNRQRAGRERAERRVNISGAGSSTKK

GTGNDVPWYQQPPDTAPKLMIYEVSNRPSGVPDRFSGSKSGTTASLTIS

GLQAEDEADYYCGLYPSSTVVFGGGTKLTVLGQPKAAPSVTLFPPSSEE

LQANKATLVCLISDFYPGAVTVAWKADSSPVKAGVETTTPSKQSNNKYA

ASSYLSLTPEQWKSHRSYSCQVTHEGSTVEKTVAPTECS

This light chain amino acid sequence can be encoded in a nucleic acid sequence of:

(SEQ ID NO: 34)

ATGTACAGGATGCAACTCCTGTCTTGCATTGCACTAAGTCTTGCACTTGT

CACGAATTCGCACTCTGAGCAGAATCGGCAGCGCGCCGGGAGGGAAAGAG

CGGAGCGAAGGGTGAACATCTCCGGCGCTGGGAGCAGCACAAAAAAAGGA

ACAGGTAACGATGTCCCCTGGTACCAGCAGCCCCCAGACACAGCCCCCAA

ACTCATGATTTATGAGGTCAGTAATCGGCCCTCAGGGGTCCCTGATCGCT

TCTCGGGGTCCAAGTCTGGCACCACGGCCTCCCTGACCATCTCGGGGCTG

CAGGCTGAGGACGAGGCCGATTATTACTGCGGCTTGTATCCAAGTAGTAC

TGTGGTTTTCGGCGGAGGGACCAAGCTGACCGTCCTAGGTCAGCCCAAGG

CTGCCCCCTCGGTCACTCTGTTCCCGCCCTCCTCTGAGGAGCTTCAAGCC

AACAAGGCCACACTGGTGTGTCTCATAAGTGACTTCTACCCGGGAGCCGT

GACAGTGGCCTGGAAGGCAGATAGCAGCCCCGTCAAGGCGGGAGTGGAGA

CCACCACACCCTCCAAACAAAGCAACAACAAGTACGCGGCCAGCAGCTAT

CTGAGCCTGACGCCTGAGCAGTGGAAGTCCCACAGAAGCTACAGCTGCCA

GGTCACGCATGAAGGGAGCACCGTGGAGAAGACAGTGGCCCCTACAGAAT

GTTCATAG

Anti-SARS-CoV-2 antibody 4021 can have a variable region comprised of a heavy chain with the amino acid sequence of:

(SEQ ID NO: 35)

MYRMQLLSCIALSLALVTNSEVQLVESGGGLVQAGGSLRLSCAASGFSF

SSTYMSWVRQAPERGLEWVSNIYTDGAAHYTDSVKGRFTISRDNSKNTL

YLQMESLRPEDTAVYYCTKVITGYSSGWRPFM(WGQGTLVTVSSASTKG

PSVFPLAPSSKSTSGGTAALGCLVKDYFPEPVTVSWNSGALTSGVHTFP

AVLQSSGLYSLSSVVTVPSSSLGTQTYICNVNHKPSNTKVDKKVEPKSC

DKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWLNGKE

YKCKVSNKALPAPIEKTISKAKGQPREPQVYTLPPSREEMTKNQVSLTC

LVKGFYPSDIAVEWESNGQPENNYKTTPPVLDSDGSFFLYSKLTVDKSR

WQQGNVFSCSVMHEALHNHYTQKSLSLSPGK

This heavy chain amino acid sequence can be encoded in a nucleic acid sequence of (SEQ ID NO: 36)

ATGTACAGGATGCAACTCCTGTCTTGCATTGCACTAAGTCTTGCACTTG

TCACGAATTCGGAGGTGCAACTGGTGGAGTCTGGGGGAGGCTTGGTCCA

GGCTGGGGGGTCCCTGAGACTCTCCTGTGCAGCCTCTGGATTCAGCTTC

AGTAGCACCTATATGAGTTGGGTCCGCCAGGCTCCAGAGAGGGGGCTGG

AGTGGGTTTCAAATATTTATACCGATGGTGCGGCACACTACACAGACTC

CGTGAAGGGCCGATTCACCATCTCCAGAGACAATTCCAAGAACACGCTG

TACCTTCAAATGGAAAGCCTGCGACCTGAGGACACGGCTGTGTATTACT

GTACGAAAGTTATCACCGGGTACAGCAGTGGCTGGCGCCCATTTGACTA

CTGGGGCCAGGGAACCCTGGTCACCGTCTCCTCAGCTAGCACCAAGGGC

CCATCGGTCTTCCCCCTGGCACCCTCCTCCAAGAGCACCTCTGGGGGCA

CAGCGGCCCTGGGCTGCCTGGTCAAGGACTACTTCCCCGAACCGGTGAC

GGTGTCGTGGAACTCAGGCGCCCTGACCAGCGGCGTGCACACCTTCCCG

GCTGTCCTACAGTCCTCAGGACTCTACTCCCTCAGCAGCGTGGTGACCG

TGCCCTCCAGCAGCTTGGGCACCCAGACCTACATCTGCAACGTGAATCA

CAAGCCCAGCAACACCAAGGTGGACAAGAAAGTTGAGCCCAAATCTTGT

GACAAAACTCACACATGCCCACCGTGCCCAGCACCTGAACTCCTGGGGG

GACCGTCAGTCTTCCTCTTCCCCCCAAAACCCAAGGACACCCTCATGAT

CTCCCGGACCCCTGAGGTCACATGCGTGGTGGTGGACGTGAGCCACGAA

GACCCTGAGGTCAAGTTCAACTGGTACGTGGACGGCGTGGAGGTGCATA

ATGCCAAGACAAAGCCGCGGGAGGAGCAGTACAACAGCACGTACCGTGT

GGTCAGCGTCCTCACCGTCCTGCACCAGGACTGGCTGAATGGCAAGGAG

TACAAGTGCAAGGTCTCCAACAAAGCCCTCCCAGCCCCCATCGAGAAAA

CCATCTCCAAAGCCAAAGGGCAGCCCCGAGAACCACAGGTGTACACCCT

GCCCCCATCCCGGGAGGAGATGACCAAGAACCAGGTCAGCCTGACCTGC

CTGGTCAAAGGCTTCTATCCCAGCGACATCGCCGTGGAGTGGGAGAGCA

ATGGGCAGCCGGAGAACAACTACAAGACCACGCCTCCCGTGCTGGACTC

CGACGGCTCCTTCTTCCTCTACAGCAAGCTCACCGTGGACAAGAGCAGG

TGGCAGCAGGGGAACGTCTTCTCATGCTCCGTGATGCATGAGGCTCTGC

ACAACCACTACACGCAGAAGAGCCTCTCCCTGTCTCCGGGTAAATGA

Anti-SARS-CoV-2 antibody 4021 can have a variable region comprised of a light chain with the amino acid sequence of:

(SEQ ID NO: 37)

MYRMQLLSCIALSLALVTNSQSALTQPASVSGSPGLSITISCTGTSGDV

GSYKSVSWYQQHPGKAPKLIIYDVNKRPSGVSDRFSGSKSGNTASLTIS

GLQAEDEADYYCSSYTSTNTLFGGGTKVTVLGQPKAAPSVTLFPPSSEE

LQANKATLVCLISDFYPGAVTVAWKADSSPVKAGVETTTPSKQSNNKYA

ASSYLSLTPEQWKSHRSYSCQVTHEGSTVEKTVAPTECS

This light chain amino acid sequence can be encoded in a nucleic acid sequence of:

(SEQ ID NO: 38)

ATGTACAGGATGCAACTCCTGTCTTGCATTGCACTAAGTCTTGCACTTG

TCACGAATTCGCAGTCTGCCCTGACTCAGCCTGCCTCCGTGTCTGGGTC

TCCTGGACTGTCGATCACCATCTCCTGCACTGGAACCAGCGGCGACGTT

GGTAGTTATAAGTCTGTCTCCTGGTACCAACAACACCCAGGCAAAGCCC

CCAAACTCATCATTTATGATGTCAATAAGCGGCCCTCAGGGGTGTCTGA

TCGCTTCTCTGGCTCCAAGTCTGGCAACACGGCCTCCCTGACCATCTCT

GGGCTCCAGGCTGAGGACGAGGCTGATTATTACTGCAGCTCATACACAA

GCACCAACACTTTATTCGGCGGAGGGACCAAGGTGACCGTCCTGGGTCA

GCCCAAGGCTGCCCCCTCGGTCACTCTGTTCCCGCCCTCCTCTGAGGAG

CTTCAAGCCAACAAGGCCACACTGGTGTGTCTCATAAGTGACTTCTACC

CGGGAGCCGTGACAGTGGCCTGGAAGGCAGATAGCAGCCCCGTCAAGGC

GGGAGTGGAGACCACCACACCCTCCAAACAAAGCAACAACAAGTACGCG

GCCAGCAGCTATCTGAGCCTGACGCCTGAGCAGTGGAAGTCCCACAGAA

GCTACAGCTGCCAGGTCACGCATGAAGGGAGCACCGTGGAGAAGACAGT

GGCCCCTACAGAATGTTCATAG

SC2 antibody 3417 binds to Sino CoV2 S1 (spike protein 1), NAC CoV2 S1, Sino CoV2 S2 (spike protein 2) ($K_d$=63 nM—Carterra LSA), Sino CoV2 S1+S2, and Sino CoV2 RBD (Receptor Binding Domain) ($K_d$=7.2 nM—Carterra LSA; $K_d$<1 pM ForteBio). SC2 antibody 3387 binds to 51 and RBD. SC2 antibody 3388 binds to NAC CoV2 S1, Sino CoV2 S2 ($K_d$=10 nM—Carterra LSA), Sino CoV2 RBD ($K_d$<1 pM—ForteBio), ProteinTech CoV2 Membrane Protein, ProteinTech CoV2 Nucleocapsid, and NAC Cov2 Mosaic. SC2 antibody 3388 also cross reacts with SARS1 S1 and SARS1 RBD. SC2 antibody 3396 binds to Sino CoV2 S2 ($K_d$=122 nM—ForteBio), Sino CoV2 RBD ($K_d$=22 nM—ForteBio), and NAC CoV2 Mosaic ($K_d$=21 nM—ForteBio). SC2 antibody 3908 binds to Sino CoV2 S1, NAC CoV2 S1, Sino CoV2 S2 ($K_d$=74 nM—ForteBio), Sino CoV2 RBD, NAC CoV2 Mosaic, and ProteinTech CoV2 Nucleocapsid. SC2 antibody 3908 also cross reacts with Coll SARS1 S1+S2 and Coll SARS1 RBD. SC2 antibody 3916 binds to NAC CoV2 S1, Sino CoV2 S2, Sino CoV2 S1+S2, Sino CoV2 RBD, NAC CoV2 Mosaic, ProteinTech Membrane Protein and ProteinTech Nucleocapsid. SC2 antibody 3916 also cross reacts with Coll SARS1 S1+S2 and Coll SARS1 RBD. SC2 antibody 3929 binds to Sino CoV2 RBD. SC2 antibody 3940 binds to Sino SARS1 51 ($K_d$=15 nM—Carterra LSA), HKU1 S1+S2 ($K_d$=17 nM—Carterra LSA), Sino CoV2 S1, NAC CoV2 S1, and Sino CoV2 RBD. SC2 antibody 3388 binds to NAC CoV2 S1, Sino CoV2 S2 ($K_d$=10 nM—Carterra LSA), Sino CoV2 RBD ($K_d$<1 pM—ForteBio), NAC COV2 Mosaic, ProteinTech Membrane Protein, and ProteinTech Nucleocapsid. SC2 antibody 3388 also cross reacts with Sino SARS1 51 and Coll SARS1 RBD. SC2 antibody 3705 NAC CoV2 S1 ($K_d$=57 nM), Sino CoV2 S1, Sino CoV2 S1+S2, and Sino CoV2 RBD ($K_d$=1.3 nM).

The anti-SARS-CoV-2 antibodies 3417 (SEQ ID NO: 1 and 3), 3387 (SEQ ID NO: 5 and 7), 3388 (SEQ ID NO: 11 and 13), 3396 (SEQ ID NO: 15 and 17), 3908 (SEQ ID NO: 19 and 21), 3916 (SEQ ID NO: 23 and 25), 3929 (SEQ ID NO: 27 and 29), 3940 (SEQ ID NO: 31 and 33), 4021 (SEQ ID NO: 35 and 37), and 3705 (SEQ ID NO: 9) also include variable regions having amino acid sequences that have 99%, 95%, 90%, 80% or 70% sequence identity with one of the heavy chains from variable region SEQ ID NO: 1, 5, 11, 15, 19, 23, 27, 31 or 35, and a light chain that has 99%, 95%, 90%, 80% or 70% sequence identity with one light chains from variable region SEQ ID NO: 3, 7, 13, 17, 21, 25, 29, 33, or 37.

CDRs from anti-SARS-CoV-2 antibodies 3417 (SEQ ID NO: 1 and 3), 3387 (SEQ ID NO: 5 and 7), 3388 (SEQ ID NO: 11 and 13), 3396 (SEQ ID NO: 15 and 17), 3908 (SEQ ID NO: 19 and 21), 3916 (SEQ ID NO: 23 and 25), 3929 (SEQ ID NO: 27 and 29), 3940 (SEQ ID NO: 31 and 33), 4021 (SEQ ID NO: 35 and 37), and 3705 (SEQ ID NO: 9) can be use to make CDR grafted antibodies known in the art.

The CDRs of SC2 antibody 3417 are:
GVSIRNSNYF heavy chain CDR1 (SEQ ID NO: 39)
MHSGGTT heavy chain CDR2 (SEQ ID NO: 40)
ARDDPLNRFAAFQI heavy chain CDR3 (SEQ ID NO: 41)
SSNIGNKY light chain CDR1 (SEQ ID NO: 42)
DNN light chain CDR2 (SEQ ID NO: 43)
GTWDSSLSVFYV light chain CDR3 (SEQ ID NO: 44)

The CDRs of SC2 antibody 3387 are:
GYTFTSYG heavy chain CDR1 (SEQ ID NO: 45)
INTYNGNT heavy chain CDR2 (SEQ ID NO: 46)
ARVAVGYCSGGSCYYFDF heavy chain CDR3 (SEQ ID NO: 47)
QSVSNN light chain CDR1 (SEQ ID NO: 48)
GAS light chain CDR2 (SEQ ID NO: 49)
QQYNDWPPSWT light chain CDR3 (SEQ ID NO: 50)

The CDRs of SC2 antibody 3388 are:
GFTFSSYA heavy chain CDR1 (SEQ ID NO: 51)
ISYDGSNK heavy chain CDR2 (SEQ ID NO: 52)
AREGNIVATISLDY heavy chain CDR3 (SEQ ID NO: 53)
SSNIGAGYD light chain CDR1 (SEQ ID NO: 54)
GNS light chain CDR2 (SEQ ID NO: 55)
QSYDSSLSVV light chain CDR3 (SEQ ID NO: 56)

The CDRs of SC2 antibody 3396 are:
GFYFADYA heavy chain CDR1 (SEQ ID NO: 57)
ISWNSGNI heavy chain CDR2 (SEQ ID NO: 58)
VKASTLYYYFYMDV heavy chain CDR3 (SEQ ID NO: 59)
SSDVGGYDY light chain CDR1 (SEQ ID NO: 60)
EVS light chain CDR2 (SEQ ID NO: 61)
CSYAGSNNYV light chain CDR3 (SEQ ID NO: 62)

The CDRs of SC2 antibody 3908 are:
GFTLSSFD heavy chain CDR1 (SEQ ID NO: 63)
IGTAGDT heavy chain CDR2 (SEQ ID NO: 64)
ARGTWLRDYNFWSGYNYYFDY heavy chain CDR3 (SEQ ID NO: 65)
SSDVGGYIY light chain CDR1 (SEQ ID NO: 66)
EVS light chain CDR2 (SEQ ID NO: 67)
SSYADSNNYV light chain CDR3 (SEQ ID NO: 68)

The CDRs of SC2 antibody 3916 are:
GGSFSGYY heavy chain CDR1 (SEQ ID NO: 69)
INHSGST heavy chain CDR2 (SEQ ID NO: 70)
ARQRGQRITMVRLKRDWFDP heavy chain CDR3 (SEQ ID NO: 71)
SSNIGSNT light chain CDR1 (SEQ ID NO: 72)
SNN light chain CDR2 (SEA ID NO: 73)
AAWDDSLNGPV light chain CDR3 (SEQ ID NO: 74)

The CDRs of SC2 antibody 3929 are:
GYTFTSYG heavy chain CDR1 (SEQ ID NO: 75)
INTYNGNT heavy chain CDR2 (SEQ ID NO: 76)
ARVAVGYCSGGSCYYFDY heavy chain CDR3 (SEQ ID NO: 77)
SSNMGSNF light chain CDR1 (SEQ ID NO: 78)
RNN light chain CDR2 (SEQ ID NO: 79)
AAWDDSLNGVV light chain CDR3 (SEQ ID NO: 80)

The CDRs of SC2 antibody 3940 are:
GYSFTSYW heavy chain CDR1 (SEQ ID NO: 81)
IYPGDSDT heavy chain CDR2 (SEQ ID NO: 82)
ARGDCSSTSCYLDY heavy chain CDR3 (SEQ ID NO: 83)
STKKGTGND light chain CDR1 (SEQ ID NO: 84)
EVS light chain CDR2 (SEQ ID NO: 85)
GLYPSSTVV light chain CDR3 (SEQ ID NO: 86)

The CDRs of SC2 antibody 4021 are:
GFSFSSTY heavy chain CDR1 (SEQ ID NO: 87)
IYTDGAA heavy chain CDR2 (SEQ ID NO: 88)
TKVITGYSGWRPFDY heavy chain CDR3 (SEQ ID NO: 89)
SGDVGSYKS light chain CDR1 (SEQ ID NO: 90)
DVN light chain CDR2 (SEQ ID NO: 91)
SSYTSTNYL light chain CDR3 (SEQ ID NO: 92)

The CDRs of SC2 antibody 3705 are:
GYTFTSYG heavy chain CDR1 (SEQ ID NO: 93)
INTYNGNT heavy chain CDR2 (SEQ ID NO: 94)
ARVAVGYCSGGSCYYFDY heavy chain CDR3 (SEQ ID NO: 95)
QSVSNN light chain CDR1 (SEQ ID NO: 96)
GAS light chain CDR2 (SEQ ID NO: 97)
QQYNDWPPSWT light chain CDR3 (SEQ ID NO: 98)

An anti-SARS-CoV-2 antibody can also include a variable region made from a nucleic acid encoding a heavy chain that has 99%, 95%, 90%, 80% or 70% sequence identity with one of the nucleic acids encoding a heavy chain (SEQ ID NO: 2, 6, 12, 16, 20, 24, 28, 32, or 36), and a nucleic acid encoding a light chain that has 99%, 95%, 90%, 80% or 70% sequence identity with one of the nucleic acids encoding a light chain (SEQ ID NO: 4, 8, 14, 18, 22, 26, 30, 34, or 38). An anti-SARS-CoV-2 antibody can also include a variable region made from a nucleic acid encoding a heavy chain that hybridizes under stringent hybridization conditions with one of the nucleic acids encoding one of the heavy chains (SEQ ID NO: 2, 6, 12, 16, 20, 24, 28, 32 or 36), and a nucleic acid encoding a light chain that hybridizes under stringent hybridization conditions with one of the nucleic acids encoding one of the light chains (SEQ ID NO: 4, 8, 14, 18, 22, 26, 30, 34, or 38).

An anti-SARS-CoV-2 antibody can be made with a variable region selected from variable regions encoded by SEQ ID NOs: 159-962. (See Table 1) The heavy chains are encoded by the odd numbered SEQ ID Nos. and the light chains are encoded by the even numbered SEQ ID NOs of each variable region pair. The identifier for each anti-SARS-CoV-2 variable region is in second column labeled Ab, so anti-SARS-CoV-2 variable region (1) is encoded by SEQ ID Nos: 159 (heavy chain) and 160 (light chain), anti-SARS-CoV-2 variable region (2) is encoded by SEQ ID Nos: 161 (heavy chain) and 162 (light chain), anti-SARS-CoV-2 variable region (3) is encoded by SEQ ID Nos: 163 (heavy chain) and 164 (light chain), etc.

LENGTHY TABLES

The patent contains a lengthy table section. A copy of the table is available in electronic form from the USPTO web site (https://seqdata.uspto.gov/?pageRequest=docDetail&DocID=US11919944B2). An electronic copy of the table will also be available from the USPTO upon request and payment of the fee set forth in 37 CFR 1.19(b)(3).

Anti-SARS-CoV-2 antibody 3910 can have a variable region comprised of a heavy chain with the amino acid sequence of:

(SEQ ID NO: 99)
QVQLQESGSGLVKPSQTLSLTCAVSGVSMSTGDYSWSWIRRPPGKGLEW
IGYIFLGGRTYSNPSLKSRVTMSIDRSKNQFSLKLTSVTAADTAVYYCA
RDRSGSGTLDYWGQGTLIAVSS

This heavy chain amino acid sequence can be encoded in a nucleic acid sequence of:

(SEQ ID NO: 100)
CAAGTGCAGCTGCAGGAGTCCGGCTCCGGACTGGTGAAGCCTTCACAGA
CCCTGTCCCTCACCTGCGCTGTCTCTGGTGTCTCCATGAGCACTGGTGA
TTACTCCTGGAGCTGGATCCGGCGGCCACCAGGGAAGGGCCTGGAGTGG
ATTGGTTACATCTTCCTAGGTGGGAGAACCTACTCCAACCCGTCCCTCA
AGAGTCGAGTCACAATGTCAATAGACAGGTCCAAGAACCAGTTCTCCCT
GAAGCTGACCTCTGTGACCGCCGCGGACACGGCCGTATATTACTGTGCC
AGAGATCGCTCTGGTTCGGGGACCCTTGACTACTGGGGCCAGGGAACCC
TGATCGCCGTCTCCTCA

Anti-SARS-CoV-2 antibody 3910 can have a variable region comprised of a light chain with the amino acid sequence of:

(SEQ ID NO: 101)
QSALTQPASVSGSPGQSITISCTGTSSDVGGYNYVSWYQQHPGKAPKLM
IYEVSNRPSGVSNRFSGSKSGNTASLTISGLQAEDEADYYCSSYTSSST
LFGGGTKLTVL

This light chain amino acid sequence can be encoded in a nucleic acid sequence of:

(SEQ ID NO: 102)
CAGTCTGCCCTGACTCAGCCTGCCTCCGTGTCTGGGTCTCCTGGACAGT
CGATCACCATCTCCTGCACTGGAACCAGCAGTGACGTTGGTGGTTATAA
CTATGTCTCCTGGTACCAACAGCACCCAGGCAAAGCCCCCAAACTCATG
ATTTATGAGGTCAGTAATCGGCCCTCAGGGGTTTCTAATCGCTTCTCTG
GCTCCAAGTCTGGCAACACGGCCTCCCTGACCATCTCTGGGCTCCAGGC
TGAGGACGAGGCTGATTATTACTGCAGCTCATATACAAGCAGCAGCACT
CTATTCGGCGGAGGGACCAAGCTGACCGTCCTA

The CDRs of SC2 antibody 3910 are:

heavy chain CDR1
(SEQ ID NO: 103)
GVSMSTGDYS heavy chain CDR2
(SEQ ID NO: 104)
IFLGGRT heavy chain CDR3
(SEQ ID NO: 105)
ARDRSGSGTLDY light chain CDR1
(SEQ ID NO: 106)
SSDVGGYNY light chain CDR2
(SEQ ID NO: 107)
EVS light chain CDR3
(SEQ ID NO: 108)
SSYTSSSTL Anti-SARS-CoV-2 antibody 3915 can have a variable region comprised of a heavy chain with the amino acid sequence of:

(SEQ ID NO: 109)
EEQLLESGGDLVWPGGSLRLSCAASGLTFSSYSTNWVRQAPGRGLEWVA
SISSTSWSRYYADSVKGRFTISRDNAKNSLYLQMNSLGVEDTAVYYCTA
DQRARNTGVIDYWGRGTLVTVSS

This heavy chain amino acid sequence can be encoded in a nucleic acid sequence of:

(SEQ ID NO: 110)
GAGGAGCAGCTGTTGGAGTCTGGGGGAGACCTGGTCTGGCCTGGGGGGT
CCCTGAGACTCTCCTGTGCAGCCTCTGGACTCACCTTCAGTAGCTATAG
CACGAACTGGGTCCGCCAGGCTCCAGGGAGGGGGCTGGAGTGGGTCGCG
TCCATTAGTAGTACTAGTTGGTCCAGATATTACGCAGACTCAGTGAAGG
GCCGATTCACCATCTCCAGAGACAACGCCAAGAACTCGCTGTATCTGCA
AATGAACAGCCTGGGAGTCGAGGATACGGCTGTGTATTACTGTACGGCA
GATCAGAGAGCTCGAAACACGGGGGTCATTGACTATTGGGGCCGGGGAA
CCCTGGTCACCGTCTCCTCA

Anti-SARS-CoV-2 antibody 3915 can have a variable region comprised of a light chain with the amino acid sequence of:

(SEQ ID NO: 111)
QSALTQPASVSGSPGQSITISCTGTSSDIGGYDYVSWYRQDPGKAPRLM

IYEVSNRPSGVSNRFSGAKSGNTASLTISGLQAEDEADYYCSSYSSTST

SVVFGGGTKLTVL

This light chain amino acid sequence can be encoded in a nucleic acid sequence of:

(SEQ ID NO: 112)
CAGTCTGCCCTGACTCAGCCTGCCTCCGTGTCTGGGTCTCCTGGACAGT

CGATCACCATCTCCTGCACTGGAACCAGCAGTGACATTGGTGGTTATGA

CTATGTCTCGTGGTACCGACAGGACCCAGGCAAGGCCCCCAGACTCATG

ATTTATGAGGTCAGTAACCGGCCCTCAGGGGTTTCTAATCGCTTCTCTG

GCGCCAAGTCTGGCAACACGGCCTCCCTGACCATCTCTGGCCTCCAGGC

TGAGGACGAGGCTGATTATTACTGCAGCTCATATTCAAGCACCAGCACC

TCTGTGGTGTTCGGCGGAGGGACCAAGCTGACCGTCCTA

The CDRs of SC2 antibody 3915 are:

heavy chain CDR1
(SEQ ID NO: 113)
GLTFSSYS heavy chain CDR2
(SEQ ID NO: 114)
ISSTSWSR heavy chain CDR3
(SEQ ID NO: 115)
TADQRARNTGVIDY light chain CDR1
(SEQ ID NO: 116)
SSDIGGYDY light chain CDR2
(SEQ ID NO: 117)
EVS light chain CDR3
(SEQ ID NO: 118)
SSYSSTSTSVV Anti-SARS-CoV-2 antibody 3945 can have a variable region comprised of a heavy chain with the amino acid sequence of:

(SEQ ID NO: 119)
QLQLQESGSGLVKPSQTLSLTCAVSGGSVSSGGYSWSWIRQPPGKGLEW

IGYIYDSGITSYNPSLKSRLTISIDRSKNQFSLGLSSVTAADTAVYYCA

RVRRNTSGSFSTGHFDYWGQGTLVTVSS

This heavy chain amino acid sequence can be encoded in a nucleic acid sequence of:

(SEQ ID NO: 120)
CAGCTGCAGCTGCAGGAGTCCGGCTCAGGACTGGTGAAGCCTTCACAGA

CCCTGTCCCTCACCTGCGCTGTCTCTGGTGGCTCCGTCAGCAGTGGTGG

-continued

TTATTCCTGGAGCTGGATCCGGCAGCCACCAGGGAAGGGCCTGGAGTGG

ATTGGGTACATCTATGATAGTGGGATCACCTCCTACAACCCGTCCCTCA

AGAGCCGACTCACCATATCAATAGACAGGTCCAAGAACCAGTTCTCCCT

GGGGCTGAGCTCTGTGACCGCCGCGGACACGGCCGTGTATTACTGTGCC

AGAGTTCGGCGGAATACTAGTGGTTCTTTCTCGACCGGCCACTTTGACT

ACTGGGGCCAGGGAACCCTAGTCACCGTCTCCTCA

Anti-SARS-CoV-2 antibody 3945 can have a variable region comprised of a light chain with the amino acid sequence of:

(SEQ ID NO: 121)
QSALTQPASVSGSPGQSITISCTGTSSDVGAYNYVSWYQHHPGKAPKLM

IYDVSDRPSGVSNRFSGSKSGNTASLTISGLQAEDEADYYCSSYTNTST

LYVFGTGTKVTVL

This light chain amino acid sequence can be encoded in a nucleic acid sequence of:

(SEQ ID NO: 122)
CAGTCTGCCCTGACTCAGCCTGCCTCCGTATCTGGGTCTCCTGGACAGT

CGATCACCATCTCCTGCACTGGAACCAGCAGTGACGTTGGTGCTTATAA

CTATGTCTCTTGGTACCAACACCACCCAGGCAAAGCCCCCAAACTCATG

ATTTATGATGTCAGTGATCGGCCCTCAGGAGTTTCTAATCGCTTCTCTG

GCTCCAAGTCTGGCAACACGGCCTCCCTGACCATCTCTGGGCTCCAGGC

TGAGGACGAGGCTGATTATTACTGCAGCTCATATACAAACACCAGCACT

CTTTATGTCTTCGGAACTGGGACCAAGGTCACCGTCCTA

The CDRs of SC2 antibody 3945 are:

heavy chain CDR1
(SEQ ID NO: 123)
GGSVSSGGYS heavy chain CDR2
(SEQ ID NO: 124)
IYDSGIT CTAC heavy chain CDR3
(SEQ ID NO: 125)
ARVRRNTSGSFSTGHFDY light chain CDR1
(SEQ ID NO: 126)
SSDVGAYNY light chain CDR2
(SEQ ID NO: 127)
DVS light chain CDR3
(SEQ ID NO: 128)
SSYTNTSTLYV Anti-SARS-CoV-2 antibody 3947 can have a variable region comprised of a heavy chain with the amino acid sequence of:

(SEQ ID NO: 129)
QLQLQESGSGLVKPSQTLSLTCAVSGGSVSSGGYSWSWIRQPPGKGLEWI

GYIYDSGITSYNPSLKSRLTISIDRSKNQFSLGLSSVTAADTAVYYCARV

RRNTSGSFSTGHFDYWGQGTLVTVSS

This heavy chain amino acid sequence can be encoded in a nucleic acid sequence of:

(SEQ ID NO: 130)
CAGCTGCAGCTGCAGGAGTCCGGCTCAGGACTGGTGAAGCCTTCACAGAC

CCTGTCCCTCACCTGCGCTGTCTCTGGTGGCTCCGTCAGCAGTGGTGGTT

ATTCCTGGAGCTGGATCCGGCAGCCACCAGGGAAGGGCCTGGAGTGGATT

GGGTACATCTATGATAGTGGGATCACCTCCTACAACCCGTCCCTCAAGAG

CCGACTCACCATATCAATAGACAGGTCCAAGAACCAGTTCTCCCTGGGGC

TGAGCTCTGTGACCGCCGCGGACACGGCCGTGTATTACTGTGCCAGAGTT

CGGCGGAATACTAGTGGTTCTTTCTCGACCGGCCACTTTGACTACTGGGG

CCAGGGAACCCTAGTCACCGTCTCCTCA

Anti-SARS-CoV-2 antibody 3947 can have a variable region comprised of a light chain with the amino acid sequence of:

(SEQ ID NO: 131)
QSVLTQPPSVSASPGQTVTISCSGSTSNIGGNYVSWYQHLPGTAPKLLIY

DSNKRPSGIPDRFSGSKSGTSATLGITGLQTEDEADYYCGTWDYRLSGAV

FGGGTKLTVL

This light chain amino acid sequence can be encoded in a nucleic acid sequence of:

(SEQ ID NO: 132)
CAGTCTGTGCTGACGCAGCCGCCCTCAGTGTCTGCGTCCCCAGGACAAAC

GGTCACCATCTCCTGCTCTGGAAGCACCTCCAACATTGGTGGTAATTATG

TCTCCTGGTACCAGCACCTCCCAGGAACAGCCCCCAAACTCCTCATTTAT

GACAGTAATAAGCGACCCTCAGGGATTCCTGACCGATTCTCTGGCTCCAA

GTCTGGCACGTCAGCCACCCTGGGCATCACCGGACTCCAGACTGAGGATG

AGGCCGATTATTACTGTGGAACATGGGATTACAGACTGAGTGGTGCGGTC

TTCGGAGGAGGGACCAAGCTGACCGTCCTA

The CDRs of SC2 antibody 3947 are:

heavy chain CDR1
(SEQ ID NO: 133)
GGSVSSGGYS heavy chain CDR2
(SEQ ID NO: 134)
IYDSGIT heavy chain CDR3
(SEQ ID NO: 135)
ARVRRNTSGSFSTGHFDY -continued light chain CDR1
(SEQ ID NO: 136)
TSNIGGNY light chain CDR2
(SEQ ID NO: 137)
GTWDYRLSGAVDSN light chain CDR3
(SEQ ID NO: 138)

Anti-SARS-CoV-2 antibody 3969 can have a variable region comprised of a heavy chain with the amino acid sequence of:

(SEQ ID NO: 139)
QVQLVESGGGVVQPGRSLRLSCAASGFTFSSYGMHWVRQAPGKGLEWVAV

ISYDGSNKYYADSVKGRFTISRDNSKNTLYLQMNSLRAEDTAVYYCAKGV

GDYAVWGQGTLVTVSS

This heavy chain amino acid sequence can be encoded in a nucleic acid sequence of:

(SEQ ID NO: 140)
CAGGTGCAGCTGGTGGAGTCTGGGGGAGGCGTGGTCCAGCCTGGGAGGTC

CCTGAGACTCTCCTGTGCAGCCTCTGGATTCACCTTCAGTAGCTATGGCA

TGCACTGGGTCCGCCAGGCTCCAGGCAAGGGGCTGGAGTGGGTGGCAGTT

ATATCATATGATGGAAGTAATAAATACTATGCAGACTCCGTGAAGGGCCG

ATTCACCATCTCCAGAGACAATTCCAAGAACACGCTGTATCTGCAAATGA

ACAGCCTGAGAGCTGAGGACACGGCTGTGTATTACTGTGCGAAAGGAGTG

GGTGACTACGCGGTCTGGGGCCAGGGAACCCTGGTCACCGTCTCCTCA

Anti-SARS-CoV-2 antibody 3969 can have a variable region comprised of a light chain with the amino acid sequence of:

(SEQ ID NO: 141)
QSALTQPASVSGSPGQSITISCTGTNSDIGGYDYVSWYQQHPGKAPKLMI

FDVNNRPSGVSNRFSGSKSGNTASLTISELQSADEADYFCSSFSTRNSLV

VFGGGTKLTVL

This light chain amino acid sequence can be encoded in a nucleic acid sequence of:

(SEQ ID NO: 142)
CAGTCTGCCCTGACTCAGCCTGCCTCCGTGTCTGGGTCTCCTGGACAGTC

GATCACCATCTCCTGCACTGGAACCAACAGTGACATTGGTGGTTATGATT

ATGTCTCCTGGTACCAACAACACCCAGGCAAAGCCCCCAAACTCATGATT

TTTGACGTCAATAATCGGCCCTCAGGGGTTTCTAATCGCTTCTCTGGCTC

CAAGTCTGGCAACACGGCCTCCCTGACCATCTCTGAGCTCCAGTCTGCGG

ACGAGGCTGATTATTTCTGCAGCTCTTTTTCAACCAGAAACTCTCTCGTG

GTGTTCGGCGGAGGGACCAAACTGACCGTCCTA

The CDRs of SC2 antibody 3969 are:

```
heavy chain CDR1
                                (SEQ ID NO: 143)
GFTFSSYG

heavy chain CDR2
                                (SEQ ID NO: 144)
ISYDGSNK

heavy chain CDR3
                                (SEQ ID NO: 145)
AKGVGDYAV

light chain CDR1
                                (SEQ ID NO: 146)
NSDIGGYDY

light chain CDR2
                                (SEQ ID NO: 147)
DVN

light chain CDR3
                                (SEQ ID NO: 148)
SSFSTRNSLVV
```

Anti-SARS-CoV-2 antibody 4083 can have a variable region comprised of a heavy chain with the amino acid sequence of:

```
                                (SEQ ID NO: 149)
QLQLQESGSGLVKPSQTLSLTCAVSGGSVSSGGYSWSWIRQPPGKGLEWI

GYIYDSGITSYNPSLKSRLTISIDRSKNQFSLGLSSVTAADTAVYYCARV

RRNTSGSFSTGHFDYWGQGTLVTVSS
```

This heavy chain amino acid sequence can be encoded in a nucleic acid sequence of:

```
                                (SEQ ID NO: 150)
CAGCTGCAGCTGCAGGAGTCCGGCTCAGGACTGGTGAAGCCTTCACAGAC

CCTGTCCCTCACCTGCGCTGTCTCTGGTGGCTCCGTCAGCAGTGGTGGTT

ATTCCTGGAGCTGGATCCGGCAGCCACCAGGGAAGGGCCTGGAGTGGATT

GGGTACATCTATGATAGTGGGATCACCTCCTACAACCCGTCCCTCAAGAG

CCGACTCACCATATCAATAGACAGGTCCAAGAACCAGTTCTCCCTGGGGC

TGAGCTCTGTGACCGCCGCGGACACGGCCGTGTATTACTGTGCCAGAGTT

CGGCGGAATACTAGTGGTTCTTTCTCGACCGGCCACTTTGACTACTGGGG

CCAGGGAACCCTAGTCACCGTCTCCTCA
```

Anti-SARS-CoV-2 antibody 4083 can have a variable region comprised of a light chain with the amino acid sequence of:

```
                                (SEQ ID NO: 151)
QSVLTQPPSVSAVPGQKVTISCSGNNSNIGNNLVSWYQQLPGTAPKWYNN

NRRPSGIPDRFSGSKSGTSATLGITGLQTGDEAAYYCAARDSSLSAVVFG

GGTKLTVL
```

This light chain amino acid sequence can be encoded in a nucleic acid sequence of:

```
                                (SEQ ID NO: 152)
CAGTCTGTGTTGACGCAGCCGCCCTCAGTGTCTGCGGTCCCAGGACAGAA

GGTCACCATCTCCTGCTCTGGAAACAACTCCAATATTGGAAATAATCTTG

TATCCTGGTACCAGCAGCTCCCAGGAACAGCCCCCAAACTCCTCATTTAT

AACAATAATAGGCGACCATCAGGGATTCCTGACCGATTCTCTGGCTCCAA

GTCTGGCACGTCAGCCACCCTGGGCATCACCGGACTCCAGACTGGGGACG

AGGCCGCTTATTATTGCGCAGCAAGGGATAGCAGCCTGAGTGCTGTGGTG

TTCGGCGGAGGGACCAAACTGACCGTCCTA
```

The CDRs of SC2 antibody 4083 are:

```
heavy chain CDR1
                                (SEQ ID NO: 153)
GGSVSSGGYS

heavy chain CDR2
                                (SEQ ID NO: 154)
IYDSGIT

heavy chain CDR3
                                (SEQ ID NO: 155)
ARVRRNTSGSFSTGHFDY

light chain CDR1
                                (SEQ ID NO: 156)
NSNIGNNL

light chain CDR2
                                (SEQ ID NO: 157)
NNN

light chain CDR3
                                (SEQ ID NO: 158)
AARDSSLSAVV
```

SC2 antibody 3910 binds to Sino CoV2 S1 (spike protein 1), NAC CoV2 S1, and Sino CoV2 RBD (Receptor Binding Domain). SC2 antibody 3915 binds to Sino CoV2 S1 (spike protein 1), NAC CoV2 S1, Sino CoV2 RBD (Receptor Binding Domain), and NAC CoV2 Mosaic. SC2 antibody 3945 binds to HKU1 S1+S2 ($K_d$=11 nM Carterra LSA). SC2 antibody 3947 binds to Sino CoV2 S2 ($K_d$=25 nM Carterra LSA) and HKU1 51+S2 ($K_d$=532 nM Carterra LSA). SC2 antibody 3969 binds to Sino SARS1 51 ($K_d$=28 nM Carterra LSA), HKU1 51+S2 ($K_d$=12 nM Carterra LSA), and Sino Cov2 RBD ($K_d$=105 nM Carterra LSA). SC2 antibody 4083 binds to Sino Cov2 S2 ($K_d$=41 nM Carterra LSA).

The anti-SARS-CoV-2 antibodies 3910 (SEQ ID NO: 99 and 101), 3915 (SEQ ID NO: 109 and 111), 3945 (SEQ ID NO: 119 and 121), 3947 (SEQ ID NO: 129 and 131), 3969 (SEQ ID NO: 139 and 141), and 4083 (SEQ ID NO: 149 and 151) also include variable regions having amino acid sequences that have 99%, 95%, 90%, 80% or 70% sequence identity with one of the heavy chains from variable region SEQ ID NO: 99, 109, 119, 129, 139, or 149, and a light chain that has 99%, 95%, 90%, 80% or 70% sequence identity with one light chains from variable region SEQ ID NO: 101, 11, 121, 131, 141, or 151.

CDRs from anti-SARS-CoV-2 antibodies 3910 (SEQ ID NO: 99 and 101), 3915 (SEQ ID NO: 109 and 111), 3945 (SEQ ID NO: 119 and 121), 3947 (SEQ ID NO: 129 and 131), 3969 (SEQ ID NO: 139 and 141), and 4083 (SEQ ID NO: 149 and 151) can be used to make CDR grafted antibodies known in the art.

An anti-SARS-CoV-2 antibody can also include a variable region made from a nucleic acid encoding a heavy chain that has 99%, 95%, 90%, 80% or 70% sequence identity with one of the nucleic acids encoding a heavy chain (SEQ ID NO: 2, 6, 12, 16, 20, 24, 28, 32, 36, 100, 110, 120, 130, 140, or 150), and a nucleic acid encoding a light chain that has 99%, 95%, 90%, 80% or 70% sequence identity with one of the nucleic acids encoding a light chain (SEQ ID NO: 4, 8, 14, 18, 22, 26, 30, 34, 38, 102, 112, 122, 132, 142, or 152). An anti-SARS-CoV-2 antibody can also include a variable region made from a nucleic acid encoding a heavy chain that hybridizes under stringent hybridization conditions with one of the nucleic acids encoding one of the heavy chains (SEQ ID NO: 2, 6, 12, 16, 20, 24, 28, 32, 36, 100, 110, 120, 130, 140, or 150), and a nucleic acid encoding a light chain that hybridizes under stringent hybridization conditions with one of the nucleic acids encoding one of the light chains (SEQ ID NO: 4, 8, 14, 18, 22, 26, 30, 34, 38, 102, 112, 122, 132, 142, or 152).

An anti-SARS-CoV-2 antibody can also include a variable region (e.g., starting from anti-SARS-CoV-2 variable regions (1) to (402)) made from a nucleic acid encoding a heavy chain that has 99%, 95%, 90%, 80% or 70% sequence identity with one of the heavy chain from variable regions 1-402 (odd numbered SEQ ID Nos), and a nucleic acid encoding a light chain that has 99%, 95%, 90%, 80% or 70% sequence identity with one of the light chain from variable region 1-402 (even numbered SEQ ID NOs). An anti-SARS-CoV-2 antibody can also include a variable region made from a nucleic acid encoding a heavy chain that hybridizes under stringent hybridization conditions with one of the nucleic acids encoding one of the heavy chains from variable regions 903-1706 (odd numbered SEQ ID Nos), and a nucleic acid encoding a light chain that hybridizes under stringent hybridization conditions with one of the nucleic acids encoding one of the light chains from variable regions 903-(even numbered SEQ ID NOs).

The CDRs for the light and heavy chains of the anti-SARS-CoV-2 variable regions 1-402 are identified in Table 2 (showing the sequences that are the CDRs). These CDRs and optionally FR amino acids from the corresponding light or heavy chain can be used to make CDR grafted antibodies as described below.

The anti-SARS-CoV-2 antibodies disclosed herein can bind to SARS-CoV-2 Spike Trimer, SARS-CoV-2 Receptor Binding Domain (RBD), SARS-CoV-2 Membrane Protein (E), and/or SARS-CoV-2 Nucleocapsid. Antigen specificity for the anti-SARS-CoV-2 variable regions are shown in Table 3. For example, antibodies that bind to SARS-CoV-2 RBD include, for example, anti-SARS-CoV-2 antibodies comprising the anti-SARS-CoV-2 variable region 2-6, 8-22, 24, 29-34, 35-39, 41-42, 162, 165, 167, 172-173, 177-178, 180, 183-184, 186-187, 192-195, 288, 296, 298-299, 303-304, 313-316, 321-323, 326-328, 332, 334, 337-338, 344-345, 347, 350, 355-356, 358-360, 368-370, 378-380. For example, antibodies that bind to SARS-CoV-2 Spike trimer include, for example, anti-SARS-CoV-2 antibodies comprising the anti-SARS-CoV-2 variable region 1-4, 7, 14-16, 19-20, 31, 37, 162, 171, 186. For example, antibodies that bind to SARS-CoV-2 Membrane Protein include, for example, anti-SARS-CoV-2 antibodies comprising the anti-SARS-CoV-2 variable region 202-209, 218-219, 222-223, 227, 229-231, 242-245, 261, 280. For example, antibodies that bind to SARS-CoV-2 Nucleocapsid include, for example, anti-SARS-CoV-2 antibodies comprising the anti-SARS-CoV-2 variable region 202-209, 214-215, 218-219, 221-223, 227, 229-231, 236, 242-243, 245, 261, 271, 280.

Any of the anti-SARS-CoV-2 antibodies described above can be made from a nucleic acid encoding a full-length antibody that lacks any introns, and so, is non-natural. The non-natural nucleic acids can include the combination of a variable region (e.g., anti-SARS-CoV-2 antibody variable regions 1-451) operably linked to a constant region (e.g., IgG1, IgG2, IgG3, or IgG4) that is non-natural for that variable region. Any of the above nucleic acids can be used to recombinantly make the anti-SARS-CoV-2 antibodies described herein. The anti-SARS-CoV-2 antibodies also include amino acid sequences that are non-natural including the combination of a variable region (e.g., anti-SARS-CoV-2 antibody variable regions 1-451) operably linked to a constant region (e.g., IgG1, IgG2, IgG3, or IgG4) that is non-natural for that variable region.

An anti-SARS-CoV-2 antibody can bind to SARS-CoV-2 with an affinity ($K_d$) of less than one picomolar. An anti-SARS-CoV-2 antibody can bind with an affinity of at least 1 pM, or at least 10 pM, or at least 100 pM.

The anti-SARS-CoV-2 antibodies disclosed herein can also be used to make chimeric antigen receptors for arming T-cells treat infections from SARS-CoV-2. For example, the antibodies can be formatted into a single chain structure recombinantly combined with appropriate transmembrane and signaling components to make a chimeric antigen receptor.

The anti-SARS-CoV-2 antibodies disclosed herein can have neutralizing activity against SARS-CoV-2 in an in vitro cell infection model. For example, the antibodies SC2 antibody 3417, SC2 antibody 3387, SC2 antibody 3396, and SC2 antibody 3705 neutralized SARS-CoV-2 and blocked the virus from infecting cells. In addition, the SC2 antibody 3387 was able to bind to spike proteins with the mutations D614G and E484K (Sweden-1 variant of European variant B-1), or D614G, V445I, H655Y, and E583D (England/Bristol variant of European variant B-1), or G485S (related to Australia-1 variant), or N501Y (South African variant B1.1), or S494P, or V483K, or R683A, R685A, F817P, A892P, A899P, A942P, K986P, V987P. The ability to bind all of these variants shows the broad specificity of these anti-SARS-CoV-2 antibodies.

Nucleic Acids

The disclosure also relates to nucleic acids that encode, at least in part, the individual peptides, polypeptides, and proteins described herein. The nucleic acids may be natural, synthetic or a combination thereof. The nucleic acids may be RNA, mRNA, DNA or cDNA.

Nucleic acids also include expression vectors, such as plasmids, or viral vectors, or linear vectors, or vectors that integrate into chromosomal DNA. Expression vectors can contain a nucleic acid sequence that enables the vector to replicate in one or more selected host cells. Such sequences are well known for a variety of cells. The origin of replication from the plasmid pBR322 is suitable for most Gram-negative bacteria. In eukaryotic host cells, e.g., mammalian cells, the expression vector can be integrated into the host cell chromosome and then replicate with the host chromosome. Similarly, vectors can be integrated into the chromosome of prokaryotic cells.

Expression vectors also generally contain a selection gene, also termed a selectable marker. Selectable markers are well-known in the art for prokaryotic and eukaryotic cells, including host cells of the invention. Generally, the selection gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. In some embodiments, an exemplary selection scheme utilizes a drug to arrest growth of a host cell. Those cells that are successfully transformed with a heterologous gene produce a protein conferring drug resistance and thus survive the selection regimen. Other selectable markers for use in bacterial or eukaryotic (including mammalian) systems are well-known in the art.

An example of a promoter that is capable of expressing a transgene encoding an immune binding protein in a mammalian host cell is the EF1a promoter. The native EF1a promoter drives expression of the alpha subunit of the elongation factor-1 complex, which is responsible for the enzymatic delivery of aminoacyl tRNAs to the ribosome. The EF1a promoter has been extensively used in mammalian expression plasmids and has been shown to be effective in driving expression from transgenes cloned into a lentiviral vector. See, e.g., Milone et al., Mol. Ther. 17(8): 1453-1464 (2009), which is incorporated by reference in its entirety for all purposes. Another example of a promoter is the immediate early cytomegalovirus (CMV) promoter sequence. This promoter sequence is a strong constitutive promoter sequence capable of driving high levels of expression of any polynucleotide sequence operatively linked thereto. Other constitutive promoter sequences may also be used, including, but not limited to the simian virus 40 (SV40) early promoter, mouse mammary tumor virus promoter (MMTV), human immunodeficiency virus (HIV) long terminal repeat (LTR) promoter, MoMuLV promoter, phosphoglycerate kinase (PGK) promoter, MND promoter (a synthetic promoter that contains the U3 region of a modified MoMuLV LTR with myeloproliferative sarcoma virus enhancer, see, e.g., Li et al., J. Neurosci. Methods vol. 189, pp. 56-64 (2010) which is incorporated by reference in its entirety for all purposes), an avian leukemia virus promoter, an Epstein-Barr virus immediate early promoter, a Rous sarcoma virus promoter, as well as human gene promoters such as, but not limited to, the actin promoter, the myosin promoter, the elongation factor-1a promoter, the hemoglobin promoter, and the creatine kinase promoter. Further, the invention is not limited to the use of constitutive promoters.

Inducible promoters are also contemplated herein. Examples of inducible promoters include, but are not limited to a metallothionine promoter, a glucocorticoid promoter, a progesterone promoter, a tetracycline promoter, a c-fos promoter, the T-REx system of ThermoFisher which places expression from the human cytomegalovirus immediate-early promoter under the control of tetracycline operator(s), and RheoSwitch promoters of Intrexon. Karzenowski, D. et al., BioTechiques 39:191-196 (2005); Dai, X. et al., Protein Expr. Purif 42:236-245 (2005); Palli, S. R. et al., Eur. J. Biochem. 270:1308-1515 (2003); Dhadialla, T. S. et al., Annual Rev. Entomol. 43:545-569 (1998); Kumar, M. B, et al., J. Biol. Chem. 279:27211-27218 (2004); Verhaegent, M. et al., Annal. Chem. 74:4378-4385 (2002); Katalam, A. K., et al., Molecular Therapy 13:S103 (2006); and Karzenowski, D. et al., Molecular Therapy 13:S194 (2006), U.S. Pat. Nos. 8,895,306, 8,822,754, 8,748,125, 8,536,354, all of which are incorporated by reference in their entirety for all purposes.

Expression vectors typically have promoter elements, e.g., enhancers, to regulate the frequency of transcriptional initiation. Typically, these are located in the region 30-110 bp upstream of the start site, although a number of promoters have been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

Control regions suitable for a bacterial host cell can be used in the expression vector. Suitable control regions for directing transcription of the nucleic acid constructs include, for example, the control regions obtained from the *E. coli* lac operon, *Streptomyces coelicolor* agarase gene (dagA), *Bacillus subtilis* levansucrase gene (sacB), *Bacillus licheniformis* alpha-amylase gene (amyl), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and the prokaryotic beta-lactamase gene, the tac promoter, or the T7 promoter.

In some embodiments, control regions for filamentous fungal host cells, include control regions obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid control regions thereof. Exemplary yeast cell control regions can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase.

Exemplary control regions for insect cells include, among others, those based on polyhedron, PCNA, OplE2, OplE1, *Drosophila* metallothionein, and *Drosophila* actin 5C. In some embodiments, insect cell promoters can be used with Baculoviral vectors.

Exemplary control regions for plant cells include, among others, those based on cauliflower mosaic virus (CaMV) 35S, polyubiquitin gene (PvUbi1 and PvUbi2), rice (*Oryza sativa*) actin 1 (OsAct1) and actin 2 (OsAct2) control regions, the maize ubiquitin 1 (ZmUbi1) control region, and multiple rice ubiquitin (RUBQ1, RUBQ2, rubi3) control regions.

The expression vector can contain one or more selectable markers, which permit selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

It may be desirable to modify the polypeptides described herein. One of skill will recognize many ways of generating alterations in a given nucleic acid construct to generate variant polypeptides Such well-known methods include site-directed mutagenesis, PCR amplification using degenerate oligonucleotides, exposure of cells containing the nucleic acid to mutagenic agents or radiation, chemical synthesis of a desired oligonucleotide (e.g., in conjunction with ligation and/or cloning to generate large nucleic acids) and other well-known techniques (see, e.g., Gillam and Smith, Gene 8:81-97, 1979; Roberts et al., Nature 328:731-734, 1987, which is incorporated by reference in its entirety for all purposes). The recombinant nucleic acids encoding the polypeptides herein can be modified to provide preferred codons which enhance translation of the nucleic acid in a selected organism.

The polynucleotides described herein also include polynucleotides including nucleotide sequences that are substantially equivalent to the polynucleotides described herein. Polynucleotides according to the invention can have at least about 80%, more typically at least about 90%, and even more typically at least about 95%, sequence identity to a polynucleotide of the invention. The invention also provides the complement of the polynucleotides including a nucleotide sequence that has at least about 80%, more typically at least about 90%, and even more typically at least about 95%, sequence identity to a polynucleotide encoding a polypeptide recited above. The polynucleotide can be DNA (genomic, cDNA, amplified, or synthetic) or RNA. Methods and algorithms for obtaining such polynucleotides are well known to those of skill in the art and can include, for example, methods for determining hybridization conditions which can routinely isolate polynucleotides of the desired sequence identities.

Nucleic acids which encode protein analogs or variants in accordance with those described herein (i.e., wherein one or more amino acids are designed to differ from the wild type polypeptide) may be produced using site directed mutagenesis or PCR amplification in which the primer(s) have the desired point mutations. For a detailed description of suitable mutagenesis techniques, see Sambrook et al., Molecular Cloning: A Laboratory Manual, Cold Spring Harbor Laboratory Press, Cold Spring Harbor, N.Y. (1989) and/or Current Protocols in Molecular Biology, Ausubel et al., eds, Green Publishers Inc. and Wiley and Sons, N.Y (1994), each of which is incorporated by reference in its entirety for all purposes. Chemical synthesis using methods well known in the art, such as that described by Engels et al., *Angew Chem Intl Ed.* 28:716-34, 1989 (which is incorporated by reference in its entirety for all purposes), may also be used to prepare such nucleic acids.

Amino acid "substitutions" for creating variants can be preferably the result of replacing one amino acid with another amino acid having similar structural and/or chemical properties, i.e., conservative amino acid replacements. Amino acid substitutions may be made on the basis of similarity in polarity, charge, solubility, hydrophobicity, hydrophilicity, and/or the amphipathic nature of the residues involved. For example, nonpolar (hydrophobic) amino acids include alanine, leucine, isoleucine, valine, proline, phenylalanine, tryptophan, and methionine; polar neutral amino acids include glycine, serine, threonine, cysteine, tyrosine, asparagine, and glutamine; positively charged (basic) amino acids include arginine, lysine, and histidine; and negatively charged (acidic) amino acids include aspartic acid and glutamic acid.

The nucleic acids described herein can be linked to another nucleic acid so as to be expressed under control of a suitable promoter. The nucleic acid can be also linked to, in order to attain efficient transcription of the nucleic acid, other regulatory elements that cooperate with a promoter or a transcription initiation site, for example, a nucleic acid comprising an enhancer sequence, a polyA site, or a terminator sequence. In addition, a gene that can be a marker for confirming expression of the nucleic acid (e.g. a drug resistance gene, a gene encoding a reporter enzyme, or a gene encoding a fluorescent protein) may be incorporated.

When the nucleic acid described herein is introduced into a cell ex vivo, the nucleic acid of may be combined with a substance that promotes transference of a nucleic acid into a cell, for example, a reagent for introducing a nucleic acid such as a liposome or a cationic lipid, in addition to the aforementioned excipients. Alternatively, a vector carrying the nucleic acid can also be useful. Particularly, a composition in a form suitable for administration to a living body which contains the nucleic acid of the present invention carried by a suitable vector is suitable for in vivo gene therapy.

Host Cells

Nucleic acids encoding an immune binding protein described herein (e.g., an antibody) can be cloned into an appropriate expression vector for expression of immune binding protein in a host cell. Host cells include, for example, bacterial, fungi, or mammalian host cells. The host cell can be a bacterium including, for example, *Bacillus*, such as *B. lichenformis* or *B. subtilis; Pantoea*, such as *P. citrea; Pseudomonas*, such as *P. alcaligenes; Streptomyces*, such as *S. lividans* or *S. rubiginosus; Escherichia*, such as *E. coli; Enterobacter; Streptococcus*; Archaea, such as *Methanosarcina mazei*; or *Corynebacterium*, such as *C. glutamicum.*

The host cells can be fungi cells, including, but not limited to, fungi of the genera *Saccharomyces, Klyuveromyces, Candida, Pichia, Debaromyces, Hansenula, Yarrowia, Zygosaccharomyces*, or *Schizosaccharomyces*. In some embodiments, the host cell is a fungi, including, among others, *Saccharomyces cerevisiae, Schizosaccharomyces pombe, Kluyveromyces lactis, Kluyveromyces marxianus, Aspergillus terreus, Aspergillus niger, Pichia pastoris, Rhizopus arrhizus, Rhizopus oryzae, Yarrowia lipolytica*, and the like. The eukaryotic cells can be algal, including but not limited to algae of the genera *Chlorella, Chlamydomonas, Scenedesmus, Isochrysis, Dunaliella, Tetraselmis, Nannochloropsis*, or Prototheca. The algae can be a green algae, red algae, glaucophytes, chlorarachniophytes, euglenids, chromista, or dinoflagellates.

The eukaryotic cells can be mammalian cells, such as mouse, rat, rabbit, hamster, porcine, bovine, feline, or canine. The mammalian cells can be cells of primates, including but not limited to, monkeys, chimpanzees, gorillas, and humans. The mammalians cells can be mouse cells, as mice routinely function as a model for other mammals, most particularly for humans (see, e.g., Hanna, J. et al., *Science* 318:1920-23, 2007; Holtzman, D. M. et al., *J Clin*

*Invest.* 103(6):R15-R21, 1999; Warren, R. S. et al., *J Clin Invest.* 95: 1789-1797, 1995; each publication is incorporated by reference in its entirety for all purposes). Animal cells include, for example, fibroblasts, epithelial cells (e.g., renal, mammary, prostate, lung), keratinocytes, hepatocytes, adipocytes, endothelial cells, and hematopoietic cells. In some embodiments, the animal cells are adult cells (e.g., terminally differentiated, dividing or non-dividing) or embryonic cells (e.g., blastocyst cells, etc.) or stem cells. The animal cell can be a cell line derived from an animal or other source, such as a Chinese hamster ovary cell line (CHO cell), or murine myeloma cell lines (NSO, Sp2/0), or human cell lines including, for example, HEK293, HT-1080, or PER.C6.

The mammalian cell can be a cell found in the circulatory system of a mammal, including humans. Exemplary circulatory system cells include, among others, red blood cells, platelets, plasma cells, T-cells, natural killer cells, B-cells, macrophages, neutrophils, or the like, and precursor cells of the same. As a group, these cells are defined to be circulating eukaryotic cells of the invention. The mammalian cells can be derived from any of these circulating eukaryotic cells. The immiuner binding proteins described herein may be used with any of these circulating cells or cells derived from the circulating cells. The mammalian cell can be a T-cell or T-cell precursor or progenitor cell. The mammalian cell can be a helper T-cell, a cytotoxic T-cell, a memory T-cell, a regulatory T-cell, a natural killer T-cell, a mucosal associated invariant T-cell, a gamma delta T cell, or a precursor or progenitor cell to the aforementioned. The mammalian cell can be a natural killer cell, or a precursor or progenitor cell to the natural killer cell. The mammalian cell can be a B-cell, or a plasma cell, or a B-cell precursor or progenitor cell. The mammalian cell can be a neutrophil or a neutrophil precursor or progenitor cell. The mammalian cell can be a megakaryocyte or a precursor or progenitor cell to the megakaryocyte. The mammalian cell can be a macrophage or a precursor or progenitor cell to a macrophage.

A source of cells can be obtained from a subject. The subject may be any living organism. Examples of subjects include humans, dogs, cats, mice, rats, and transgenic species thereof. T cells can be obtained from a number of sources, including peripheral blood mononuclear cells, bone marrow, lymph node tissue, cord blood, thymus tissue, tissue from a site of infection, ascites, pleural effusion, spleen tissue, and tumors. Any number of T cell lines available in the art, may be used. T cells can be obtained from a unit of blood collected from a subject using any number of techniques known to the skilled artisan, such as Ficoll separation. Cells from the circulating blood of an individual can be obtained by apheresis. The apheresis product typically contains lymphocytes, including T cells, monocytes, granulocytes, B cells, other nucleated white blood cells, red blood cells, and platelets. The cells collected by apheresis may be washed to remove the plasma fraction and to place the cells in an appropriate buffer or media for subsequent processing steps. The cells can be washed with phosphate buffered saline (PBS). In an alternative aspect, the wash solution lacks calcium and may lack magnesium or may lack many if not all divalent cations. Initial activation steps in the absence of calcium can lead to magnified activation.

Plant cells can be cells of monocotyledonous or dicotyledonous plants, including, but not limited to, alfalfa, almonds, asparagus, avocado, banana, barley, bean, blackberry, brassicas, broccoli, cabbage, canola, carrot, cauliflower, celery, cherry, chicory, citrus, coffee, cotton, cucumber, eucalyptus, hemp, lettuce, lentil, maize, mango, melon, oat, papaya, pea, peanut, pineapple, plum, potato (including sweet potatoes), pumpkin, radish, rapeseed, raspberry, rice, rye, sorghum, soybean, spinach, strawberry, sugar beet, sugarcane, sunflower, tobacco, tomato, turnip, wheat, zucchini, and other fruiting vegetables (e.g. tomatoes, pepper, chili, eggplant, cucumber, squash etc.), other bulb vegetables (e.g., garlic, onion, leek etc.), other pome fruit (e.g. apples, pears etc.), other stone fruit (e.g., peach, nectarine, apricot, pears, plums etc.), *Arabidopsis*, woody plants such as coniferous and deciduous trees, an ornamental plant, a perennial grass, a forage crop, flowers, other vegetables, other fruits, other agricultural crops, herbs, grass, or perennial plant parts (e.g., bulbs; tubers; roots; crowns; stems; stolons; tillers; shoots; cuttings, including un-rooted cuttings, rooted cuttings, and callus cuttings or callus-generated plantlets; apical meristems etc.). The term "plants" refers to all physical parts of a plant, including seeds, seedlings, saplings, roots, tubers, stems, stalks, foliage and fruits.

CDR Grafted Antibodies

CDR grafted forms of antibodies are chimeric immunoglobins, immunoglobulin chains or fragments thereof (such as Fv, Fab, Fab', $F(ab')_2$ or other antigen-binding subsequences of antibodies) which contain CDR sequences derived from one immunoglobulin grafted into the framework sequences of a second immunoglobulin. CDR grafted antibodies include immunoglobulins (recipient antibody) in which residues from a complementary determining region (CDR) of the recipient antibody are replaced by residues from a CDR of another antibody (donor antibody) having the desired specificity, affinity and capacity. In some instances, Fv framework residues of the recipient antibody are replaced by corresponding residues from the donor antibody. CDR grafted antibodies may also comprise residues which are found neither in the recipient antibody nor in the donor CDR or framework sequences. In general, the CDR grafted antibody will comprise substantially all of at least one, and typically two, variable domains, in which all or substantially all of the CDR regions correspond to those of a donor antibody and all or substantially all of the FR regions are those of a recipient antibody consensus sequence. The CDR grafted antibody optimally also will comprise at least a portion of an immunoglobulin constant region (Fc), typically that of a recipient antibody [Jones et al., Nature, 321:522-525 (1986); Riechmann et al., Nature, 332:323-329 (1988); and Presta, Curr Op. Struct. Biol., 2:593-596 (1992), all of which are incorporated by reference in their entirety for all purposes].

Humanization is one type of CDR grafting to make a chimeric antibody. Methods for humanizing non-human antibodies are well known in the art. Generally, humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers [Jones et al., Nature, 321:522-525 (1986); Riechmann et al., Nature, 332:323-327 (1988); Verhoeyen et al., Science, 239:1534-1536 (1988), all of which are incorporated by reference in their entirety for all purposes], by substituting rodent CDRs or CDR sequences for the corresponding sequences of a human antibody. Accordingly, such "humanized" antibodies are chimeric antibodies (U.S. Pat. No. 4,816,567 which is incorporated by reference in its entirety for all purposes), wherein substantially less than an intact human variable domain has been substituted by the corresponding sequences from a non-human species. In practice, humanized antibodies are typically human antibodies in which some CDR residues and possibly some FR residues are substituted by residues from analogous sites in rodent antibodies.

Multispecific Antibodies

It may be desirable to generate multispecific (e.g. bispecific) antibodies having binding specificities for at least two different epitopes. Exemplary bispecific antibodies may bind to two different epitopes of SARS-CoV-2. Alternatively, an anti-SARS-CoV-2 arm may be combined with an arm which binds to a triggering molecule on a leukocyte such as a T-cell receptor molecule (e.g., CD2 or CD3), or Fc receptors for IgG (Fc gamma Receptor), such as FcgRI (CD64), FcgRII (CD32) and FcgRIII (CD16). Bispecific antibodies may also be used to localize cytotoxic agents. These antibodies possess an SARS-CoV-2-binding arm and an arm which binds the cytotoxic agent (e.g., saporin, anti-interferon-alpha, *vinca* alkaloid, ricin A chain, methotrexate or radioactive isotope hapten). Bispecific antibodies can be prepared as full length antibodies or antibody fragments (e.g., $F(ab')_2$ bispecific antibodies).

According to another approach for making bispecific antibodies, the interface between a pair of antibody molecules can be engineered to maximize the percentage of heterodimers which are recovered from recombinant cell culture. The preferred interface comprises at least a part of the CH3 domain of an antibody constant domain. In this method, one or more small amino acid side chains from the interface of the first antibody molecule are replaced with larger side chains (e.g., tyrosine or tryptophan). Compensatory "cavities" of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers. See WO96/27011 published Sep. 6, 1996, which is incorporated by reference in its entirety for all purposes.

Bispecific antibodies include cross-linked or "heteroconjugate" antibodies. For example, one of the antibodies in the heteroconjugate can be coupled to avidin, the other to biotin. Heteroconjugate antibodies may be made using any convenient cross-linking methods. Suitable cross-linking agents are well known in the art, and are disclosed in U.S. Pat. No. 4,676,980, which is incorporated by reference in its entirety for all purposes, along with a number of cross-linking techniques.

Techniques for generating bispecific antibodies from antibody fragments have also been described in the literature. For example, bispecific antibodies can be prepared using chemical linkage. Brennan et al., Science 229:81 (1985) (which is incorporated by reference in its entirety for all purposes) describe a procedure wherein intact antibodies are proteolytically cleaved to generate F(ab')2 fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes. In yet a further embodiment, Fab'-SH fragments directly recovered from *E. coli* can be chemically coupled in vitro to form bispecific antibodies. Shalaby et al., J. Exp. Med. 175:217 225 (1992) (which is incorporated by reference in its entirety for all purposes).

Various techniques for making and isolating bispecific antibody fragments directly from recombinant cell culture have also been described. For example, bispecific antibodies have been produced using leucine zippers. Kostelny et al., J. Immunol. 148(5):1547 1553 (1992), which is incorporated by reference in its entirety for all purposes. The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA 90:6444 6448 (1993) which is incorporated by reference in its entirety for all purpose, has provided an alternative mechanism for making bispecific antibody fragments. The fragments comprise a heavy-chain variable domain (VII) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See Gruber et al., J. Immunol. 152:5368 (1994) which is incorporated by reference in its entirety for all purposes. Alternatively, the bispecific antibody may be a "linear antibody" produced as described in Zapata et al. Protein Eng. 8(10):1057 1062 (1995) which is incorporated by reference in its entirety for all purposes.

Antibodies with more than two valencies are contemplated. For example, trispecific antibodies can be prepared. Tutt et al., J. Immunol. 147:60 (1991) which is incorporated by reference in its entirety for all purposes.

Modified Antibodies

An anti-SARS-CoV-2 antibody can include a moiety that extends a half-life ($T_{1/2}$) or/and the duration of action of the antibody. The moiety can extend the circulation $T_{1/2}$, blood $T_{1/2}$, plasma $T_{1/2}$, serum $T_{1/2}$, terminal $T_{1/2}$, biological $T_{1/2}$, elimination $T_{1/2}$ or functional $T_{1/2}$, or any combination thereof, of the antibody.

An anti-SARS-CoV-2 antibody may be modified by a single moiety. Alternatively, an anti-SARS-CoV-2 antibody may be modified by two or more substantially similar or identical moieties or two or more moieties of the same type. An anti-SARS-CoV-2 antibody may include two or more moieties of different types, or two or more different types of moieties. Two or more anti-SARS-CoV-2 antibodies can also be attached to one moiety. The attachment between the anti-SARS-CoV-2 antibody and the moiety can be covalent or noncovalent.

A polypeptide moiety can be recombinantly fused to the N-terminus or the C-terminus of the heavy chain or the light chain of an anti-SARS-CoV-2 antibody, optionally via a linker. The linker may contain about 4-30 amino acid residues. The linker may contain from about 6 or 8 amino acid residues to about 20 amino acid residues, or from about 6 or 8 amino acid residues to about 15 amino acid residues.

A protracting moiety can be human serum albumin (HSA) or a portion thereof (e.g., domain III) that binds to the neonatal Fc receptor (FcRn). The HSA or FcRn-binding portion thereof can optionally have one or more mutations that confer a beneficial property or effect. In some embodiments, the HSA or FcRn-binding portion thereof has one or more mutations that enhance pH-dependent HSA binding to FcRn or/and increase HSA half-life, such as K573P or/and E505G/V547A. A protracting moiety can be an unstructured polypeptide.

A protracting moiety can be a carboxy-terminal peptide (CTP) derived from the (3-subunit of human chorionic gonadotropin (hCG). In the human body, the fourth, fifth, seventh and eight serine residues of the 34-aa CTP of hCG-β typically are attached to O-glycans terminating with a sialic acid residue.

A protracting moiety can be 1, 2, 3, 4, 5 or more moieties of a synthetic polymer. The synthetic polymer can be biodegradable or non-biodegradable. Biodegradable polymers useful as protracting moieties include, but are not limited to, poly(2-methacryloyloxyethyl phosphorylcholine) (PMPC) and poly[oligo(ethylene glycol) methyl ether methacrylate] (POEGMA). Non-biodegradable polymers useful as protracting moieties include without limitation poly(ethylene glycol) (PEG), polyglycerol, poly(N-(2-hydroxypropyl)methacrylamide) (PHPMA), polyoxazolines and poly (N-vinylpyrrolidone) (PVP). A synthetic polymer can be polyethylene glycol (PEG). PEGylation can be done by chemical or enzymatic, site-specific coupling or by random coupling.

The protracting moieties can also include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1, 3-dioxolane, poly-1,3,6-trioxane, ethylene/maleic anhydride copolymer, polyaminoacids (either homopolymers or random copolymers), and dextran or poly(n-vinyl pyrrolidone)polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

The individual mass (e.g., average molecular weight), or the total mass, of the one or more synthetic polymer moieties can be about 10-50, 10-20, 20-30, 30-40 or 40-50 kDa, or about 10, 20, 30, or 50 kDa. The individual mass (e.g., average MW), or the total mass, of the one or more synthetic polymer moieties also can be greater than about 50 kDa, such as about 50-100, 50-60, 60-70, 70-80, 80-90 or 90-100 kDa, or about 60, 70, 80, 90 or 100 kDa. Moreover, the mass (e.g., average MW) of an individual synthetic polymer moiety can be less than about 10 kDa, such as about 1-5 or 5-10 kDa, or about 5 kDa. The individual mass (e.g., average MW), or the total mass, of the one or more synthetic polymer (e.g., PEG) moieties can be about 20 or 40 kDa.

Pharmaceutical Compositions

Antibodies specifically binding SARS-CoV-2 identified herein, as well as other immune binding proteins identified by the screening assays disclosed hereinbefore, can be administered for the treatment of various disorders in the form of pharmaceutical compositions.

Pharmaceutical compositions generally are prepared according to current good manufacturing practice (GMP), as recommended or required by, e.g., the Federal Food, Drug, and Cosmetic Act § 501(a)(2)(B) and the International Conference on Harmonisation Q7 Guideline.

Pharmaceutical compositions/formulations can be prepared in sterile form. For example, pharmaceutical compositions/formulations for parenteral administration by injection or infusion generally are sterile. Sterile pharmaceutical compositions/formulations are compounded or manufactured according to pharmaceutical-grade sterilization standards known to those of skill in the art, such as those disclosed in or required by the United States Pharmacopeia Chapters 797, 1072 and 1211, and 21 Code of Federal Regulations 211.

Pharmaceutically acceptable excipients and carriers include pharmaceutically acceptable substances, materials and vehicles. Non-limiting examples of types of excipients include liquid and solid fillers, diluents, binders, lubricants, glidants, surfactants, dispersing agents, disintegration agents, emulsifying agents, wetting agents, suspending agents, thickeners, solvents, isotonic agents, buffers, pH adjusters, absorption-delaying agents, stabilizers, antioxidants, preservatives, antimicrobial agents, antibacterial agents, antifungal agents, chelating agents, adjuvants, sweetening agents, flavoring agents, coloring agents, encapsulating materials and coating materials. The use of such excipients in pharmaceutical formulations is known in the art. For example, conventional vehicles and carriers include without limitation oils (e.g., vegetable oils such as olive oil and sesame oil), aqueous solvents {e.g., saline, buffered saline (e.g., phosphate-buffered saline [PBS]) and isotonic solutions (e.g., Ringer's solution)}, and organic solvents (e.g., dimethyl sulfoxide [DMSO] and alcohols [e.g., ethanol, glycerol and propylene glycol]). Except insofar as any conventional excipient or carrier is incompatible with an anti-SARS-CoV2 antibody or a fragment thereof, the disclosure encompasses the use of conventional excipients and carriers in formulations containing an anti-SARS-CoV2 antibody or a fragment thereof. See, e.g., Remington: The Science and Practice of Pharmacy, 21st Ed., Lippincott Williams & Wilkins (Philadelphia, Pennsylvania) (2005); Handbook of Pharmaceutical Excipients, 5th Ed., Rowe et al., Eds., The Pharmaceutical Press and the American Pharmaceutical Association (2005); Handbook of Pharmaceutical Additives, 3rd Ed., Ash and Ash, Eds., Gower Publishing Co. (2007); and Pharmaceutical Pre-formulation and Formulation, Gibson, Ed., CRC Press (Boca Raton, Florida) (2004).

Appropriate formulation can depend on various factors, such as the route of administration chosen. Potential routes of administration of a pharmaceutical composition comprising an anti-SARS-CoV2 antibody or a fragment thereof include without limitation oral, parenteral (including intradermal, subcutaneous, intramuscular, intravascular, intravenous, intraarterial, intraperitoneal, intramedullary, intrathecal and topical), intracavitary, and topical (including dermal/epicutaneous, transdermal, mucosal, transmucosal, intranasal [e.g., by nasal spray or drop], intraocular [e.g., by eye drop], pulmonary [e.g., by oral or nasal inhalation], buccal, sublingual, rectal [e.g., by suppository], and vaginal [e.g., by suppository]). Topical formulations can be designed to produce a local or systemic therapeutic effect. In certain embodiments, an anti-SARS-CoV2 antibody or a fragment thereof is administered parenterally (e.g., intravenously, subcutaneously, intramuscularly or intraperitoneally) by injection (e.g., as a bolus) or by infusion over a period of time.

Excipients and carriers that can be used to prepare parenteral formulations include without limitation solvents (e.g., aqueous solvents such as water, saline, physiological saline, buffered saline [e.g., phosphate-buffered saline], balanced salt solutions [e.g., Ringer's BSS] and aqueous dextrose solutions), isotonic/iso-osmotic agents (e.g., salts [e.g., NaCl, KCl and $CaCl_2$)] and sugars [e.g., sucrose]), buffering agents and pH adjusters (e.g., sodium dihydrogen phosphate [monobasic sodium phosphate]/disodium hydrogen phosphate [dibasic sodium phosphate], citric acid/sodium citrate and L-histidine/L-histidine HCl), and emulsifiers (e.g., non-ionic surfactants such as polysorbates [e.g., polysorbate 20 and 80] and poloxamers [e.g., poloxamer 188]). Protein formulations and delivery systems are discussed in, e.g., A. J. Banga, Therapeutic Peptides and Proteins: Formulation, Processing, and Delivery Systems, 3rd Ed., CRC Press (Boca Raton, Florida) (2015).

The excipients can optionally include one or more substances that increase protein stability, increase protein solubility, inhibit protein aggregation or reduce solution viscosity, or any combination or all thereof. Examples of such substances include without limitation hydrophilic amino acids (e.g., arginine and histidine), polyols (e.g., myo-inositol, mannitol and sorbitol), saccharides {e.g., glucose (including D-glucose [dextrose]), lactose, sucrose and trehalose}, osmolytes (e.g., trehalose, taurine, amino acids [e.g., glycine, sarcosine, alanine, proline, serine, L-alanine and γ-aminobutyric acid], and betaines [e.g., trimethylglycine and trimethylamine N-oxide]), and non-ionic surfactants {e.g., alkyl polyglycosides, ProTek® alkylsaccarides (e.g., a monosaccharide [e.g., glucose] or a disaccharide [e.g., maltose or sucrose] coupled to a long-chain fatty acid or a corresponding long-chain alcohol), and polypropylene glycol/polyethylene glycol block co-polymers (e.g., poloxamers [e.g., Pluronic™ F-68], and Genapol® PF-10 and variants thereof)}. Because such substances increase protein solubility, they can be used to increase protein concentration in a formulation. Higher protein concentration in a formulation is particularly advantageous for subcutaneous administration, which has a limited volume of bolus administration (e.g., ≤about 1.5 mL). In addition, such substances can be used to stabilize proteins during the preparation, storage and reconstitution of lyophilized proteins. Formulations and excipients for inhalation delivery are known in the art including, for example, those described in U.S. Pat. No. 5,898,028 which is hereby incorporated by reference in its entirety for all purposes.

For parenteral (e.g., intravenous, subcutaneous or intramuscular) administration, a sterile solution or suspension of an anti-SARS-CoV2 antibody in an aqueous solvent containing one or more excipients can be prepared beforehand and can be provided in, e.g., a pre-filled syringe. Alternatively, an anti-SARS-CoV2 antibody can be dissolved or suspended in an aqueous solvent that can optionally contain one or more excipients prior to lyophilization (freeze-drying). Shortly prior to parenteral administration, the lyophilized anti-SARS-CoV2 antibody stored in a suitable container (e.g., a vial) can be reconstituted with, e.g., sterile water that can optionally contain one or more excipients. If the anti-SARS-CoV2 antibody is to be administered by infusion (e.g., intravenously), the solution or suspension of the reconstituted anti-SARS-CoV2 antibody can be added to and diluted in an infusion bag containing, e.g., sterile saline (e.g., about 0.9% NaCl).

Excipients that enhance transmucosal penetration of smaller proteins include without limitation cyclodextrins, alky saccharides (e.g., alkyl glycosides and alkyl maltosides [e.g., tetradecylmaltoside]), and bile acids (e.g., cholic acid, glycocholic acid, taurocholic acid, deoxycholic acid, glycodeoxycholic acid, chenodeoxycholic acid and dehydrocholic acid).

Excipients that enhance transepithelial or transdermal penetration of smaller proteins include without limitation chemical penetration enhancers (CPEs, including fatty acids [e.g., oleic acid]), cell-penetrating peptides {CPPs, including arginine-rich CPPs [e.g., polyarginines such as R6-R11 (e.g., R6 and R9) and TAT-related CPPs such as TAT(49-57)] and amphipathic CPPs [e.g., Pep-1 and penetratin]}, and skin-penetrating peptides (SPPs, such as the skin-penetrating and cell-entering [SPACE] peptide). Transdermal penetration of smaller proteins can be further enhanced by use of a physical enhancement technique, such as iontophoresis, cavitational or non-cavitational ultrasound, electroporation, thermal ablation, radio frequency, microdermabrasion, microneedles or jet injection. US 2007/0269379 provides an extensive list of CPEs. F. Milletti, Drug Discov. Today, 17:850-860 (2012) is a review of CPPs. R. Ruan et al., Ther. Deliv., 7:89-100 (2016) discuss CPPs and SPPs for transdermal delivery of macromolecules, and M. Prausnitz and R. Langer, Nat. Biotechnol., 26:1261-1268 (2008) discuss a variety of transdermal drug-delivery methods.

An anti-SARS-CoV-2 antibody can be delivered from a sustained-release composition. As used herein, the term "sustained-release composition" encompasses sustained-release, prolonged-release, extended-release, slow-release and controlled-release compositions, systems and devices. Protein delivery systems are discussed in, e.g., Banga (supra). A sustained-release composition can deliver a therapeutically effective amount of an anti-SARS-CoV2 antibody over a prolonged time period. In some embodiments, a sustained-release composition delivers an anti-SARS-CoV2 antibody over a period of at least about 3 days, 1 week, 2 weeks, 3 weeks, 1 month (4 weeks), 6 weeks, 2 months, 3 months or longer. A sustained-release composition can be administered, e.g., parenterally (e.g., intravenously, subcutaneously or intramuscularly).

A sustained-release composition of a protein can be in the form of, e.g., a particulate system, a lipid or oily composition, or an implant. Particulate systems include without limitation nanoparticles, nanospheres, nanocapsules, microparticles, microspheres and microcapsules. Nanoparticulate systems generally have a diameter or an equivalent dimension smaller than about 1 μm. In certain embodiments, a nanoparticle, nanosphere or nanocapsule has a diameter or an equivalent dimension of no more than about 500, 400 or 300 nm, or no more than about 200, 150 or 100 nm. In some embodiments, a microparticle, microsphere or microcapsule has a diameter or an equivalent dimension of about 1-200, 100-200 or 50-150 μm, or about 1-100, 1-50 or 50-100 μm. A nano- or microcapsule typically contains the therapeutic agent in the central core, while the therapeutic agent typically is dispersed throughout a nano- or microparticle or sphere. In certain embodiments, a nanoparticulate system is administered intravenously, while a microparticulate system is administered subcutaneously or intramuscularly.

In some embodiments, a sustained-release particulate system or implant is made of a biodegradable polymer or/and a hydrogel. In certain embodiments, the biodegradable polymer comprises lactic acid or/and glycolic acid [e.g., an L-lactic acid-based copolymer, such as poly(L-lactide-co-glycolide) or poly(L-lactic acid-co-D,L-2-hydroxyoctanoic acid)]. Non-limiting examples of polymers of which a hydrogel can be composed include polyvinyl alcohol, acrylate polymers (e.g., sodium polyacrylate), and other homopolymers and copolymers having a relatively large number of hydrophilic groups (e.g., hydroxyl or/and carboxylate groups). The biodegradable polymer of the particulate system or implant can be selected so that the polymer substantially completely degrades around the time the period of treatment is expected to end, and so that the byproducts of the polymer's degradation, like the polymer, are biocompatible.

Alternatively, a sustained-release composition of a protein can be composed of a non-biodegradable polymer. Examples of non-biodegradable polymers include without limitation poloxamers (e.g., poloxamer 407). Sustained-release compositions of a protein can be composed of other natural or synthetic substances or materials, such as hydroxyapatite.

Sustained-release lipid or oily compositions of a protein can be in the form of, e.g., liposomes, micelles (e.g., those composed of biodegradable natural or/and synthetic polymers, such as lactosomes), and emulsions in an oil.

A sustained-release composition can be formulated or designed as a depot, which can be injected or implanted, e.g., subcutaneously or intramuscularly. A depot can be in the form of, e.g., a polymeric particulate system, a polymeric implant, or a lipid or oily composition. A depot formulation can comprise a mixture of a protein and, e.g., a biodegradable polymer [e.g., poly(lactide-co-glycolide)] or a semi-biodegradable polymer (e.g., a block copolymer of lactic acid and PEG) in a biocompatible solvent system, whether or not such a mixture forms a particulate system or implant.

A pharmaceutical composition can be presented in unit dosage form as a single dose wherein all active and inactive ingredients are combined in a suitable system, and components do not need to be mixed to form the composition to be administered. The unit dosage form generally contains an effective dose of the therapeutic agent. A representative example of a unit dosage form is a single-use pen comprising a pre-filled syringe, a needle and a needle cover for parenteral (e.g., intravenous, subcutaneous or intramuscular) injection of the therapeutic agent.

Alternatively, a pharmaceutical composition can be presented as a kit in which the therapeutic agent, excipients and carriers (e.g., solvents) are provided in two or more separate containers (e.g., ampules, vials, tubes, bottles or syringes) and need to be combined to form the composition to be administered. The kit can contain instructions for storing, preparing and administering the composition (e.g., a solution to be injected intravenously or subcutaneously).

Methods for Making Immune Binding Proteins

Suitable host cells for making immune binding proteins recombinantly (e.g., anti-SARS-CoV-2 antibodies) include higher eukaryote cells described herein, including vertebrate host cells. Propagation of vertebrate cells in culture (tissue culture) has become a routine procedure. Examples of useful mammalian host cell lines are monkey kidney CV 1 line transformed by SV40 (COS-7, ATCC CRL 1651); human embryonic kidney line (293 or 293 cells subcloned for growth in suspension culture. Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather. Biol. Reprod. 23:243-251 (1980)); monkey kidney cells (CV1 ATCC CCL 70); African green monkey kidney cells (VERO-76, ATCC CRL-1587); human cervical carcinoma cells (HFLA, ATCC CCL 2); canine kidney cells (MDCK, ATCC CCL 34); buffalo rat liver cells (BRL 3A, ATCC CRL 1442); human lung cells (W138. ATCC CCL 75): human liver cells (Hep G2, HB 8065); mouse mammary tumor (MMT 060562. ATCC CCL51); TRI cells (Mather et al., Annals N.Y. Acad. Sci. 383:44-68 (1982)); MRC 5 cells; FS4 cells: and a human hepatoma line (Hep G2).

The host cells used to produce the immune binding proteins described herein (e.g., anti-SARS-CoV-2 antibodies) may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM). Sigma) are suitable for culturing the host cells. In addition, any of the media described in Ham et al., Meth. Enz. 58:44 (1979), Barnes et al., Anal. Biochem. 102:255 (1980), U.S. Pat. Nos. 4,767,704; 4,657,866; 4,927,762; 4,560,655; or 5,122,469; WO 90/03430; WO 87/00195; or U.S. Pat. No. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

Anti-SARS-CoV-2 antibodies made recombinantly as described above, will typically have altered glycosylation from naturally occurring human antibodies. For example, if the anti-SARS-CoV-2 antibodies are made in CHO cells, the glycosylation on the full-length antibodies will be non-human, and can change biochemical properties of the antibodies and change the half-life of the antibodies. The nucleic acids encoding the anti-SARS-CoV-2 antibodies and used to recombinantly produce the anti-SARS-CoV-2 antibodies can be codon optimized for the host cell used to recombinantly make the antibodies. The codon optimization can be done on at least one or more codons of the nucleic acid to make a non-naturally occurring nucleic acid. Methods for codon optimizing nucleic acids for recombinant production are well known in the art.

Combination Therapies

As noted above, the methods herein, include administering to the subject one or more additional therapeutic agents in combination with an antibody or other immune binding proteins obtained (e.g., anti-SARS-CoV-2 antibody). As used herein, the expression "in combination with" means that the additional therapeutic agents is/are administered before, after, or concurrent with the pharmaceutical composition comprising the immune binding proteins described herein (e.g., anti-SARS-CoV-2 antibody). The term "in combination with" also includes sequential or concomitant administration of the immune binding protein described herein and a second therapeutic agent (which could be a different immune binding protein described herein).

Combination therapies may include an anti-SARS-CoV antibody and any additional therapeutic agent that may be advantageously combined with an antibody described herein, or with a biologically active fragment of an antibody described herein. For example, a second or third therapeutic agent may be employed to aid in reducing the viral load in the lungs, such as an antiviral, for example, Remdesivir (Veklury), ribavirin, nucleoside analogs, etc. The antibodies may also be used in conjunction with other therapies, including a toxoid, a vaccine specific for SARS-CoV-2, a second antibody specific for SARS-CoV-2, or an antibody specific for another SARS-CoV-2 antigen. The additional therapeutic agent can also be one that ameliorates certain symptoms of SARS-CoV-2, such as, for example, cytokine storm, fever, inflammation, etc. Additional therapeutic agents can include, for example, dexamethasone, other corticosteroids, etc.

Applications

The immune binding proteins described herein can be used in therapies for infectious diseases, cancer, allergies, and autoimmune diseases. The methods described herein can be used to make repertoires of immune binding proteins from subjects that have been challenged/infected with an infectious agent. The immune binding proteins described herein can be used in therapies to treat subjects infected with an infectious agent such as coronavirus (e.g., SARS-CoV-2). Addition of the exogenous immune binding protein (e.g., anti-SARS-CoV-2 antibody) helps the subject's body accelerate its own immune response to a pathogen, in effect "transplanting" the immunity from one individual to another. The immune binding proteins described herein can be used prophylactically to provide protection to those individuals who are particularly susceptible to a disease or particularly susceptible to bad outcomes from a disease. The immune binding proteins described herein can also be used in diagnostic applications. The immune binding proteins described herein can provide information on a subject's response to a therapy. The immune binding proteins described herein can provide information on a subject's response to an antibody therapy, small molecule drug therapy, biologic therapy, or cellular immunotherapy.

The immune binding proteins (e.g., anti-SARS-CoV-2antibodies) can be obtained from a subject that neutralized an infectious agent and overcame the infection. The infectious agent can be a bacterial strain of Staphylococci, *Streptococcus, Escherichia coli, Pseudomonas*, or *Salmonella*. The infectious agent can be a *Staphylococcus aureus, Neisseria gonorrhoeae, Streptococcus pyogenes*, Group A *Streptococcus*, Group B *Streptococcus* (*Streptococcus agalactiae*), *Streptococcus pneumoniae*, and *Clostridium tetani*. The infectious agent can be a bacterial pathogen that may infect host cells including, for example, *Helicobacter pyloris, Legionella* pneumophilia, a bacterial strain of Mycobacteria sps. (e.g. *M. tuberculosis, M. avium, M. intracellulare, M. kansaii*, or *M. gordonea*), *Neisseria meningitides, Listeria monocytogenes, R. rickettsia, Salmonella* spp., *Brucella* spp., *Shigella* spp., or certain *E. coli* strains or other bacteria that have acquired genes with invasive factors. The infectious agent can be a bacterial pathogen that is antibiotic resistant.

The infectious agent can be a viral pathogen including, for example, coronavirus (e.g., SARS-CoV-2), Ebola, Zika, RSV, Retroviridae (e.g. human immunodeficiency viruses such as HIV-1 and HIV-LP), Picornaviridae (e.g. poliovirus, hepatitis A virus, enterovirus, human coxsackievirus, rhinovirus, and echovirus), rubella virus, coronavirus, vesicular stomatitis virus, rabies virus, ebola virus, parainfluenza virus, mumps virus, measles virus, respiratory syncytial virus, influenza virus, hepatitis B virus, parvovirus, Adenoviridae, Herpesviridae [e.g. type 1 and type 2 herpes simplex virus (HSV), varicella-zoster virus, cytomegalovirus (CMV), and herpes virus], Poxviridae (e.g. smallpox virus, vaccinia virus, and pox virus), or hepatitis C virus.

The immune binding proteins described herein can be used to boost the immunity of a subject against an infectious disease (e.g., SARS-CoV-2). For example, in coronavirus infections the body responds within 7-10 days to a challenge; however, in immunocompromised patients such as the elderly or subjects with other underlying risk factors, the immune response timing or extent may be insufficient to fight off the infection, resulting in severe complications and possibly death. By boosting the immune system with antibodies designed to neutralize the relevant strain of coronavirus, the infection in the subject can treated. The immune binding proteins described herein (e.g., anti-SARS-CoV-2 antibodies) are used to treat infected patients and/or passively immunize vulnerable populations facing an outbreak. The immune binding proteins described herein can be administered prophylactically to protect subjects from infection (e.g., by SARS-CoV-2). Such prophylactic administration of the immune binding proteins can protect at risk groups of subjects from a disease.

The infectious agent can be a coronavirus (e.g., SARS-CoV-2), a herpes simplex virus 1 (HSV-1), herpes simplex virus 2 (HSV-2), varicella zoster, Epstein-Barr, cytomegalovirus (CMV), or Kaposi's sarcoma viruses. HSV-1 primarily causes oral herpes, ocular herpes, and herpes encephalitis, and occasionally causes genital herpes; HSV-2 primarily causes genital herpes but can also cause oral herpes; varicella zoster causes chickenpox and shingles; Epstein-Barr causes mononucleosis and is associated with several cancers including Burkitt's lymphoma; CMV causes mononucleosis-like syndrome and congenital/neonatal morbidity and mortality. Some of the herpesviridae, and in particular HSV-1, have been associated with and proposed as causative agents for Alzheimer's Disease. In some embodiments, immune binding proteins of the invention can be used to treat and/or passively immunize against these herpesviridae. An injection or topical application of an antibody against HSV-1 or HSV-2 can be employed to reduce the incidence or severity of the effects of herpes outbreaks.

The immune binding proteins described herein can be useful for treating subjects with autoimmune diseases or whom have cytokine storm response to pathogen infections (e.g., SARS-CoV-2). The autoimmune disease can be rheumatoid arthritis, lupus, celiac disease, Sjorgren's syndrome, polymyalgia rheumatica, multiple sclerosis, ankylosing spondylitis, Type 1 diabetes, and the like. The immune binding proteins described herein bind the antigen target of the autoimmune disease or the SARS-CoV-2 without triggering the autoimmune/cytokine storm reaction. For example, the immune binding protein could be an antibody without an Fc region, or could be an antibody in a format that does not interact with the effector cells that are associated with the autoimmune disease. The immune binding protein described herein binds to the autoimmune antigen without triggering an autoimmune reaction and this binding can prevent the subject's immune system from reacting with the autoimmune antigen reducing the autoimmune disease (this can be a competitive inhibition reaction).

All publications and patents cited in this specification are herein incorporated by reference as if each individual publication or patent were specifically and individually indicated to be incorporated by reference and are incorporated herein by reference to disclose and describe the methods and/or materials in connection with which the publications are cited.

EXAMPLES

Example 1 Antibodies Against Coronavirus (SARS-CoV-2)

Figure 3:
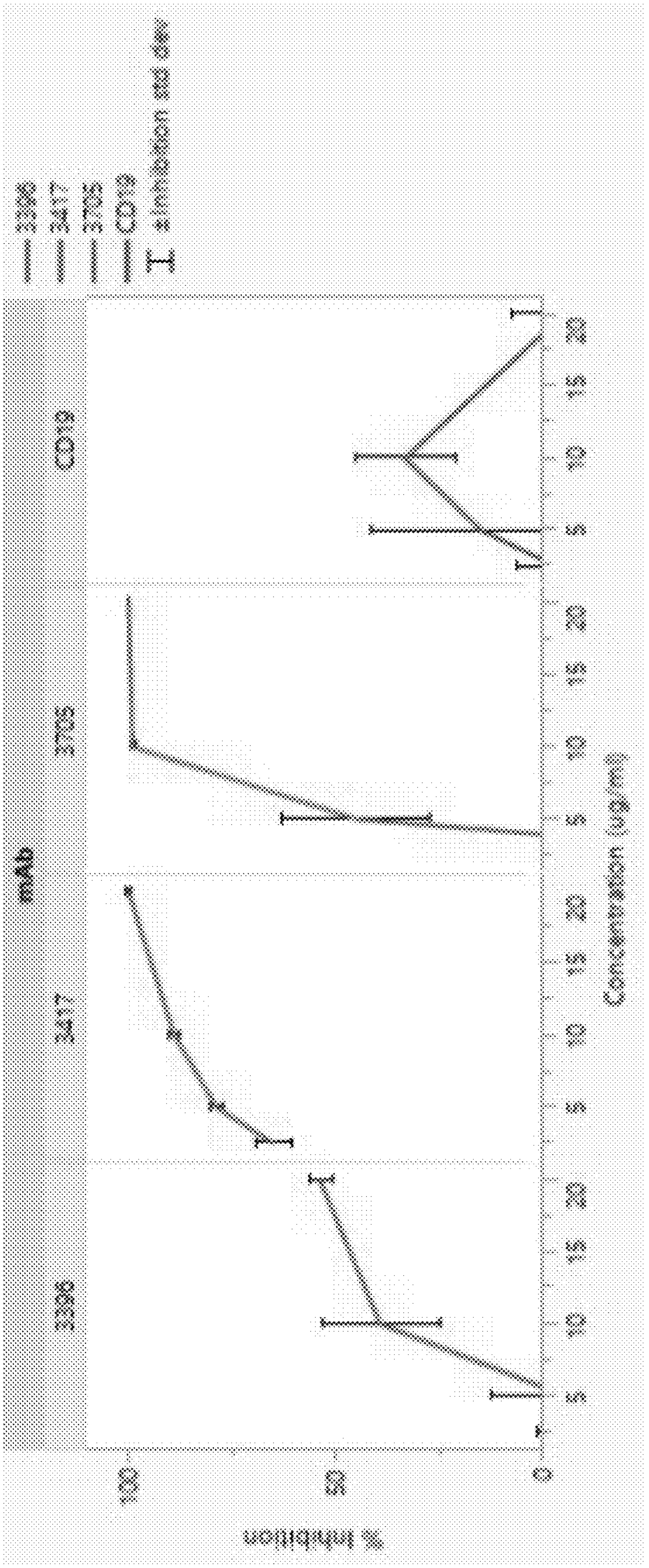
FIG. 3 shows a line graph of virus neutralization by the anti-SARS-CoV2 antibodies.

The work flow of FIG. 3 was adapted for making antibodies against coronavirus SARS-CoV-2. See, for example, U.S. Ser. No. 16/826,189 filed Mar. 21, 2020, which is hereby incorporated by reference in its entirety for all purposes. In this work flow, blood/serum samples are obtained from patients who have mounted an immune response to SARS-CoV-2 virus (from contracting SARS-CoV-2 by exposure to other infected patients). A solution of Pierce 1 micron beads bound to SARS-CoV-2 S1+S2 were added to the substrate, 3 um BangsLabs COMPEL blue fluorescent beads loaded with a predetermined SARS-CoV-2 antigen (in some assays SARS-CoV-2 51 protein, in others SARS-CoV-2 E+M+S1+S2 protein), 3 um BangsLabs COMPEL green magnetic beads loaded with a separate predetermined SARS-CoV-2 antigen (in some assays SARS-CoV-2 RBD, in others SARS-CoV-2 S2 protein), 6 um COMPEL blue magnetic beads loaded with a separate predetermined SARS-CoV-2 protein (in some assays SARS-CoV-2 Receptor Binding Domain). The blood/serum was depleted of T-cells and these T-cell depleted PBMC's were loaded onto a substrate. In some cases, PBMC's from blood were cultured to differentiate them into plasma cells before loading onto substrate. The cells and beads and secondary antibody were incubated for 24 hours under appropriate culture conditions. with a goat anti-human Fab antibody bound to R-phycoerythrin ("secondary antibody"). The microscope was used to identify halos of fluorescent beads that captured secreted antibodies from proximal cells due to antibody/antigen interactions and were stained with the secondary antibody. In this manner it was possible to automatically demultiplex antigen binding based on the secondary antibody fluorescent image pixels masked by positive pixels from the green or blue channels, and optionally masked by pixels positive using a Top Hat transform to further demultiplex antigen specificity by size. Cells with halos were selected with the device and placed into 96 well plates where subsequent molecular biology results in amplification and sequencing of immune receptor nucleic acids.

After picking single cells into lysis buffer, cells were lysed at 70C in the presence of poly dT primer. RT buffer and reverse transcriptase were added and single cell cDNA produced at 55C. Gene specific amplification of heavy and light chains was performed after the addition of DNA polymerase (Kapa HiFi), buffer and primers and PCR thermal cycling. Amplified genes were barcoded with well specific barcodes in a subsequent PCR reaction, all cDNA's for a single chain from a plate pooled, chain/plate libraries barcoded with chain/plate specific barcodes in a subsequent PCR reaction, and then chain/plate libraries normalized and pooled before loading on an Illumina MiSeq sequencer. Reads were separated by their plate/well/chain and put through an analysis pipeline that involved clustering reads based on sequence entropy to make a consensus assembly, consensus sequences found by aligning all reads in a well/chain/plate barcode group to each assembly and making basecalls by consensus, and then annotating each sequence by alignment with IgBlast against a human germline reference database. Paired antibody genes were then synthesized, cloned into an expression vector and expressed in HEK293 cells and/or as ScFv fragments. Full length antibodies were assayed for binding with ForteBio and Luminex assays.

Example 2 Binding Affinity of Anti-SARS-CoV-2 Antibodies

Affinity of selected anti-SARS-CoV-2 antibodies was measured using mean fluorescence intensity. SARS-CoV-2 antigens were conjugated to Luminex beads and binding assays were performed on a Luminex200 instrument based on the manufacturer's protocol. The following antigens were tested for binding affinity: 51 (Sino Biological), S2 (Sino Biological), 51+S2 (Sino Biological), RBD (Sino Biological), NAC 51 (The Native Antigen Company), NAC Mosaic (The Native Antigen Company).

Antibodies were attached to a ForteBio AHC antibody probe according to manufacturer's recommended protocol, equilibrated and then measured against antigens. Signals from a reference sensor were subtracted from the binding measurement and a curve for a 2:1 kinetic model was fit to the data.

| Antibody Number | SEQ ID NO: | S1 MFI | S2 MFI | S1 + S2 MFI | RBD MFI | NAC S1 MFI | NAC Mosaic MFI |
|---|---|---|---|---|---|---|---|
| 220 | 439 | 18.5 | 164.3 | 113.8 | 464.5 | 162.5 | 426.8 |
| 220 | 440 | 18.5 | 164.3 | 113.8 | 464.5 | 162.5 | 426.8 |
| 219 | 437 | 21.5 | 259.8 | 152 | 304.8 | 210 | 648.5 |
| 219 | 438 | 21.5 | 259.8 | 152 | 304.8 | 210 | 648.5 |
| 226 | 451 | 28790.5 | 92.8 | 25234.8 | 29196.5 | 27787.8 | 192.3 |
| 226 | 452 | 28790.5 | 92.8 | 25234.8 | 29196.5 | 27787.8 | 192.3 |

The MFI data was used to calculate the Kd for binding to RBD.

| Antibody Number | SEQ ID NO: | RBD Kd |
|---|---|---|
| 220 | 439 | <1.0E−12 |
| 220 | 440 | <1.0E−12 |
| 219 | 437 | <1.0E−12 |
| 219 | 438 | <1.0E−12 |
| 226 | 451 | <1.0E−12 |
| 226 | 452 | <1.0E−12 |

The anti-SARS-CoV-2 antibodies 219, 220 and 226 each bound to the SARS-CoV-2 RBP (receptor binding domain) with affinities of less than 1 picomolar.

Example 3. Development of Masked Anti-SARS-CoV-2 Proteins for Diagnostic Assays and Vaccines Antibodies discovered in the sequence listing are used to bind their respective proteins at their respective epitopes. Once these antibodies have bound their particular epitopes, a thiol and/or amine reactive PEGylation reagent at 1 mM is introduced to chemically react with amino acid side chains that are not masked by the antibody binding its epitope. The mixture is added to a Tris and/or DTT buffer to quench the PEGylation reagent and buffer exchanged. The antibody-antigen interaction is broken with heat and/or changes in pH and filtered over a Protein A/G column to remove the blocking antibodies. The resulting protein is PEGylated at all regions except the antibody binding epitope. The protein is used for vaccination in order to elicit an immune response to the original binding epitope and/or diagnostic purposes which seek to identify antibodies that bind the same epitope as the original masking antibody.

Example 4. Development of an Antibody-Adjuvant Vaccine

Antibodies discovered in the sequence listing can be used to bind their respective proteins at their respective epitopes. The antibody/antigen mixture is used as a vaccine to elicit antibody responses at the sites unbound by the antibodies and/or improve TCR responses to the bound antigen through macrophage/dendritic cell engulfment of the antibody-antigen complex and cross-presentation of antigen peptides.

Example 5: Neutralization of SARS-CoV-2 by Anti-SARS-CoV-2 Antibodies

Anti-SARS-CoV-2 antibodies were tested for neutralization activity in an in vitro assay. See, E.g., Crawford et al, Protocol and reagents for pseudotyping lentiviral particles with SARS-CoV2 Spike protein for neutralization assays, 2020, Viruses doi: 19.3390/v12050513, which is hereby incorporated by reference in its entirety for all purposes. Lentivirus was engineered to express the SARS-CoV-2 spike (1+2) protein, and antibodies were tested for inhibition of infection in HEK293 cells. In this assay the pseudo typed lentivirus infect the HEK293 cells using the spike protein binding to ACE2 on the HEK293 cells. SC2 antibodies 3705, 3417, 3387, and 3396 all showed neutralization of SARS-CoV-2 in this in vitro assay. In this assay, the SC2 antibody 3705 showed 100% neutralization of infection, SC2 antibody 3417 showed about 70% neutralization, SC2 antibody 3396 showed about 50% neutralization, and SC2 antibody 3387 showed about 45% neutralization.

Figure 2:
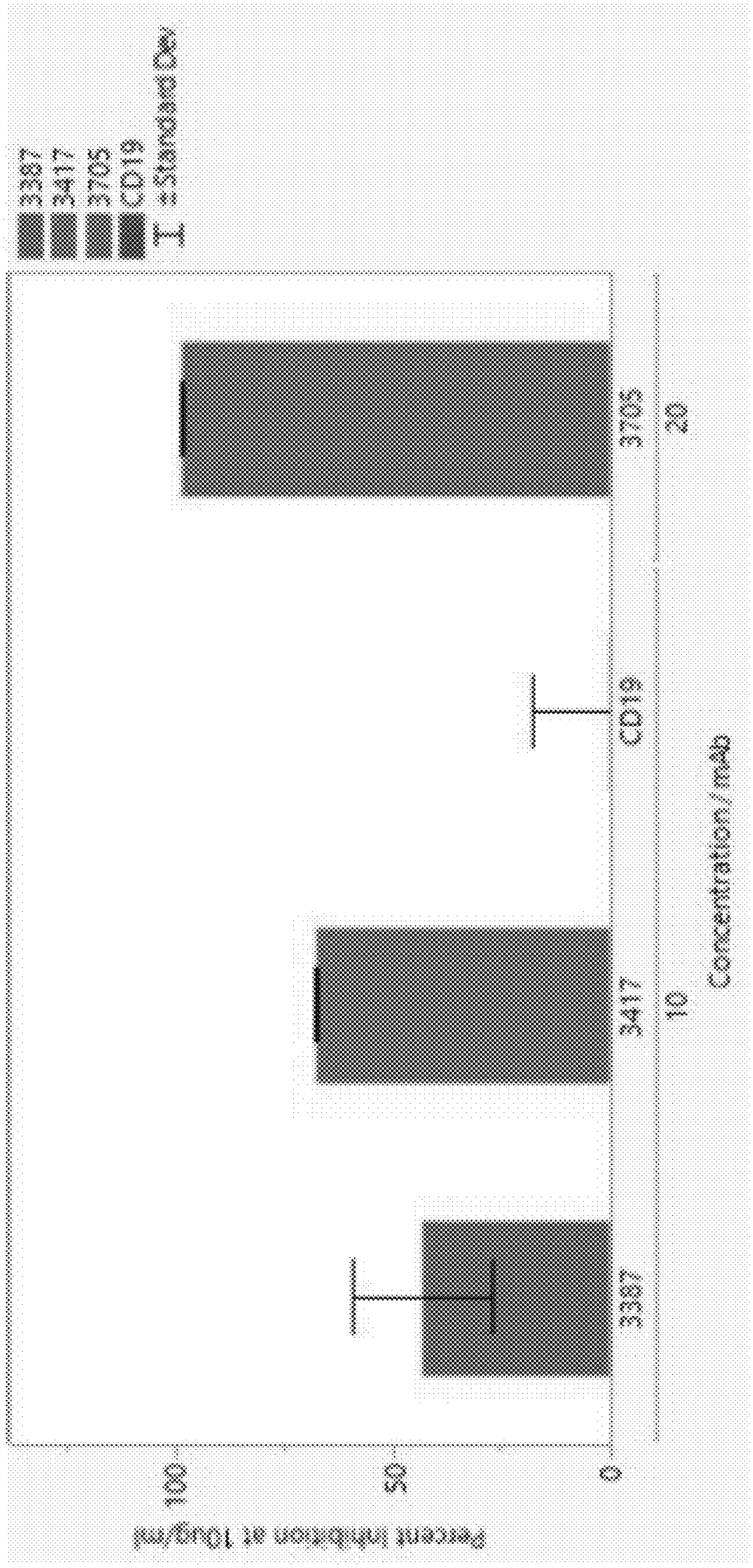
FIG. 2 shows a bar graph of virus neutralization by the anti-SARS-CoV2 antibodies.

A bar graph of virus neutralization by SC2 antibodies 3705, 3417 and 3387 is shown in FIG. 2. A line graph showing virus neutralization by SC2 antibodies 3705, 3417, and 3396 is shown in FIG. 3.

Example 6: Binding of Spike Protein Variants by Anti-SARS-CoV-2 Antibodies

Mutant SARS-CoV-2 51 proteins and SARS-CoV-1 S protein were conjugated separately to Luminex beads with EDC-NHS chemistry. SC2 antibody 3387 was incubated with antigen conjugated beads and antibody binding was detected using PE conjugated anti-human Fab antibody and a Luminex 200 instrument.

Spike protein with mutations D614G and E484K (Sweden-1 variant of European variant B-1), or D614G, V445I, H655Y, and E583D (England/Bristol variant of European variant B-1), or G485S (related to Australia-1 variant), or N501Y (South African variant B1.1), or S494P, or V483K, or R683A, R685A, F817P, A892P, A899P, A942P, K986P, V987P were tested.

SC2 antibody 3387 was able to bind each of these mutants spike proteins with affinity similar to that of the wild-type spike protein.

All publications and patents cited in this specification are herein incorporated by reference as if each individual publication or patent were specifically and individually indicated to be incorporated by reference and are incorporated herein by reference to disclose and describe the methods and/or materials in connection with which the publications are cited.

Those skilled in the art will recognize or be able to ascertain using no more than routine experimentation, many equivalents to the specific embodiments of the invention described herein. Such equivalents are intended to be encompassed by the following claims.

SEQUENCE LISTING (962 sequences)

SEQ ID NO: 1 - protein, 472 aa, Homo sapiens
MYRMQLLSCIALSLALVTNSQVQLQESGPGLLKPSQTLSLTCTVSGVSIRNSNYFWNWIRRPAGKGLEWIGRMHSGGTTNYNPSLKSRVTVSSDAARNQFSLELTSVTAADTAVYYCARDDPLNRFAAFQIWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - DNA, 1419 bp, Homo sapiens
atgtacaggatgcaactcctgtcttgcattgcactaagtcttgcacttgtcacgaattcgcaggtgcagctgcaggagtcgggcccaggactgctgaagccctcgcagaccctgtccctcacctgcactgtctctggtgtctccatcagaaatagtaattacttctggaattggatccggcggcccgccgggaagggactggagtggattgggcgtatgcatagtggtgggaccaccaattacaatccctccctcaagagtcgggtcaccgtgtcaagtgacgcggccaggaaccagttctccctggagttgacctctgtgaccgccgcagacacggccgtgtattactgtgcgagagatgacccccttaaccggttcgctgcttttcaaatctggggccgagggacactggtcaccgtctcttcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 3 - protein, 237 aa, Homo sapiens
MYRMQLLSCIALSLALVTNSQSVLTQPPSVSAAPGQKVTISCSGSSSNIGNKYISWYQQLPGTAPKLLIYDNNKRPSGIPDRFSGSKSGTSATLGITGLQTGDEADYYCGTWDSSLSVFYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4 - DNA, 714 bp, Homo sapiens
atgtacaggatgcaactcctgtcttgcattgcactaagtcttgcacttgtcacgaattcgcagtctgtgttgacgcagccgccctcagtgtctgcggccccaggacagaaggtcaccatctcctgctctggaagcagctccaacattgggaataaatatatatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgttttttatgtcttcggaactgggaccaaggtcaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 5 - protein, 475 aa, Homo sapiens
MYRMQLLSCIALSLALVTNSQVQLVQSGAEVMQVGASVKVSCKASGYTFTSYGISWVRQAPGQGLEWMGWINTYNGNTNYAQKLQGRVTMTTDTSTTTAYMELRSLRSDDTAVYYCARVAVGYCSGGSCYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6 - DNA, 1428 bp, Homo sapiens
atgtacaggatgcaactcctgtcttgcattgcactaagtcttgcacttgtcacgaattcgcaggttcagctggtgcagtctggagctgaggtgatgcaagtgggggcctcagtgaaggtctcctgcaaggcttctggttacacctttaccagctatggtatcagctgggtgcgacaggcccccggacaagggcttgagtggatgggatggatcaacacttacaatggtaacacaaactatgcacagaagctccagggcagagtcaccatgaccacagacacatccacgaccacagcctacatggagctgaggagcctgagatctgacgacacggccgtgtattactgtgcgagagtcgctgtaggatattgcagtggtggtagctgctactactttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 7 - protein, 237 aa, Homo sapiens
MYRMQLLSCIALSLALVTNSPEIVMTQSPATLSVSPGERATLSCRASQSVSNNLAWYQQKPGQAPRLLIYGASTRATGIPARFSGSGSGTEFTLTISSLQSEDFAVYYCQQYNDWPPSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8 - DNA, 714 bp, Homo sapiens
atgtacaggatgcaactcctgtcttgcattgcactaagtcttgcacttgtcacgaattcaccggaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctggaacagagttcactctcaccatcagcagcctgcagtctgaagattttgcagtttattactgtcagcagtataatgactggcctccgtcttggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 9 - protein, 315 aa, Homo sapiens
MKYLLPTAAAGLLLLAAQPAMALEIVMTQSPATLSVSPGERATLSCRASQSVSNNLAWYQQKPGQAPRLLIYGASTRATGIPARFSGSGSGTEFTLTISSLQSEDFAVYYCQQYNDWPPSWTFGQGTKVEIKGGGGSGGGGSGGGGSQVQLVQSGAEVMQVGASVKVSCKASGYTFTSYGISWVRQAPGQGLEWMGWINTYNGNTNYAQKLQGRVTMTTDTSTTTAYMELRSLRSDDTAVYYCARVAVGYCSGGSCYYFDYWGQGTLVTVSSGGGGSGGQHHHHHHGAEQKLISEEDLGSGKPIPNPLLGLDSTS

SEQ ID NO: 10 - DNA, 948 bp, Homo sapiens
atgaaatacctattgcctacggcggccgctggattgttattactcgcggcccagccggccatggcattagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctggaacagagttcactctcaccatcagcagcctgcagtctgaagattttgcagtttattactgtcagcagtataatgactggcctccgtcttggacgttcggccaagggaccaaggtggaaatcaaaggaggaggaggctctgggggcggcggttctggaggaggtggaagtcaggtgcagctggttcagtctggcgccgaagtgatgcaagtgggggcatcagtgaaggtgtcctgtaaggcttccggttatacctttaccagctatggaatctcgtgggtgcggcaggcccctggacaagggcttgagtggatgggatggattaatacttacaatgggaacacaaactatgcacagaaactccagggcagagtaaccatgactactgacacatccacgaccacagcctacatggagctgaggagcttacgatctgatgacacggccgtttattactgtgcgcgcgtcgctgtaggctattgcagtggtggcagctgctactacttcgattactggggccagggaacattggtcaccgtcagttcaggaggcggtggttcaggtggacaacaccatcaccaccatcatggcgcagaacaaaaactcatctcagaagaggatctgggtagtggcaagccgatcccgaatcctctgctgggattagactccacatcttaa

SEQ ID NO: 11 - protein, 471 aa, Homo sapiens
MYRMQLLSCIALSLALVTNSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREGNIVATISLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - DNA, 1416 bp, Homo sapiens
atgtacaggatgcaactcctgtcttgcattgcactaagtcttgcacttgtcacgaattcgcaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagaagggaatatagtggctacgatttctctggactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 13 - protein, 236 aa, Homo sapiens
MYRMQLLSCIALSLALVTNSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 14 - DNA, 711 bp, Homo sapiens
atgtacaggatgcaactcctgtcttgcattgcactaagtcttgcacttgtcacgaattcgcagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgtggtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 15 - protein, 471 aa, Homo sapiens
MYRMQLLSCIALSLALVTNSGVQLVESGGGLVQPGRSLRVSCAASGFTFADYAMHWVRQAPGKGLEWVSGISWNSGNIAYADSVKGRFTISRDNAKNSLYLQMDSLRPDDTALYYCVKASTLYYYFYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 16 - DNA, 1416 bp, Homo sapiens
atgtacaggatgcaactcctgtcttgcattgcactaagtcttgcacttgtcacgaattcgggagtgcagctggtggagtctgggggaggcttggtacagcctggcaggtccctgagagtctcctgtgcagcctctggattcacctttgctgattacgccatgcactgggtccggcaagctccagggaagggcctggagtgggtctcaggaatcagttggaatagtggtaacatagcctatgcggactctgtgaagggccgattcaccatctccagagacaacgccaagaactccctgtatcttcaaatggacagtctgagacctgatgacacggccctgtattattgtgtaaaggcctcaaccctctactactatttctacatggatgtctggggcaaagggaccacggtcaccgtttcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 17 - protein, 236 aa, Homo sapiens
MYRMQLLSCIALSLALVTNSQSALTQPPSASGSPGQSVTISCTGTSSDVGGYDYVSWYQQHPGKAPKFMIYEVSKRPSGVPDRFSGSKSGNTASLTVSGLQAEDEADYYCCSYAGSNNYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 18 - DNA, 711 bp, Homo sapiens
atgtacaggatgcaactcctgtcttgcattgcactaagtcttgcacttgtcacgaattcgcagtctgccctgactcagcctccctccgcgtccgggtctcctggacagtcagtcaccatctcctgcactggaaccagcagtgacgttggtggttatgactatgtctcctggtaccaacagcacccaggcaaagcccccaaattcatgatttatgaggtcagtaagcggccctcaggggtccctgatcgcttctctggctccaagtctggcaacacggcctccctgaccgtctctgggctccaggctgaggatgaggctgattattactgctgctcatatgcaggcagcaacaattatgtcttcggaactgggaccaaggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 19 - protein, 477 aa, Homo sapiens
MYRMQLLSCIALSLALVTNSEVQLVESRGGLVQPGGSLRLSCAATGFTLSSFDMHWVRQATGKGLEWVSAIGTAGDTYYPGSVKGRFTISRENAKNSLYLQMNSLRAGDTAVYYCARGTWLRDYNFWSGYNYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 20 - DNA, 1434 bp, Homo sapiens
atgtacaggatgcaactcctgtcttgcattgcactaagtcttgcacttgtcacgaattcggaggtgcagctggtggagtctaggggaggcttggtacagcctggggggtccctgagactctcctgtgcagccactggattcaccctcagtagcttcgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagggacctggctccgagattacaatttttggagtggttataattactactttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 21 - protein, 236 aa, Homo sapiens
MYRMQLLSCIALSLALVTNSQSALTQPPSASGSPGQSVTISCTGTSSDVGGYIYVSWYQQHPGKAPKLIIYEVSKRPSGVPDRFSGSKSGNTASLTVSGLQAEDEADYYCSSYADSNNYVFGSGTRVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 22 - DNA, 711 bp, Homo sapiens
atgtacaggatgcaactcctgtcttgcattgcactaagtcttgcacttgtcacgaattcgcagtctgccctgactcagcctccctccgcgtccgggtctcctggacagtcagtcaccatctcctgcactggaaccagcagtgacgttggtggttatatctatgtctcctggtaccaacaacacccaggcaaagcccccaaactcatcatttatgaggtcagtaagcggccctcaggggtccctgatcgcttctctggctccaagtctggcaacacggcctccctgaccgtctctgggctccaggctgaagatgaggctgattattattgcagctcatatgcagacagcaacaattatgtcttcggaagtgggaccagggtcaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 23 - protein, 476 aa, Homo sapiens
MYRMQLLSCIALSLALVTNSQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARQRGQRITMVRLKRDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - DNA, 1431 bp, Homo sapiens
atgtacaggatgcaactcctgtcttgcattgcactaagtcttgcacttgtcacgaattcgcaggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgaggcaaagggggcaacgtattactatggttcggctaaaacgggactggttcgacccctggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 25 - protein, 236 aa, Homo sapiens
MYRMQLLSCIALSLALVTNSQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 26 - DNA, 711 bp, Homo sapiens
atgtacaggatgcaactcctgtcttgcattgcactaagtcttgcacttgtcacgaattcgcagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcctgtattcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 27 - protein, 475 aa, Homo sapiens
MYRMQLLSCIALSLALVTNSQVQLVQSGAEVMTVGASVKVSCKASGYTFTSYGISWVRQAPGQGLEWMGWINTYNGNTNYAQKLQGRVTMTTDTSTTTAYMELRSLRSDDTAVYYCARVAVGYCSGGSCYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - DNA, 1428 bp, Homo sapiens
atgtacaggatgcaactcctgtcttgcattgcactaagtcttgcacttgtcacgaattcgcaggttcagctggtgcagtctggagctgaggtgatgacagtgggggcctcagtgaaggtctcctgcaaggcttctggttacacctttaccagctatggtatcagctgggtgcgacaggcccccggacaagggcttgagtggatgggatggatcaacacttacaatggtaacacaaactatgcacagaagctccagggcagagtcaccatgaccacagacacatccacgaccacagcctacatggagctgaggagcctgagatctgacgacacggccgtgtattactgtgcgagagtcgctgtaggatattgcagtggtggtagctgctactactttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 29 - protein, 236 aa, Homo sapiens
MYRMQLLSCIALSLALVTNSQSVLTQPPSASGTPGQRVTISCSGSSSNMGSNFVYWYQHLPGTAPKLLIQRNNQRPSGVPDRFSGSKSGTSASLAISGLRSEDEADYYCAAWDDSLNGVVFGGGTALTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 30 - DNA, 711 bp, Homo sapiens
atgtacaggatgcaactcctgtcttgcattgcactaagtcttgcacttgtcacgaattcgcagtctgtgctgactcagccaccctcagcgtctgggacccccgggcagagggtcaccatctcttgttctggaagcagttccaatatgggaagtaattttgtatactggtaccagcacctcccaggaacggcccccaaactcctcatccaaagaaataatcagcggccctcaggggtccctgaccgattctctggctccaagtctggcacctcagcctccctggccatcagtgggctccggtccgaggatgaggctgattactactgtgcagcatgggatgacagcctgaatggtgtggtcttcggcggagggaccgcgctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 31 - protein, 471 aa, Homo sapiens
MYRMQLLSCIALSLALVTNSEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGDCSSTSCYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - DNA, 1416 bp, Homo sapiens
atgtacaggatgcaactcctgtcttgcattgcactaagtcttgcacttgtcacgaattcggaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaggggcgattgtagtagtaccagctgctaccttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 33 - protein, 235 aa, Homo sapiens
MYRMQLLSCIALSLALVTNSHSEQNRQRAGRERAERRVNISGAGSSTKKGTGNDVPWYQQPPDTAPKLMIYEVSNRPSGVPDRFSGSKSGTTASLTISGLQAEDEADYYCGLYPSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 34 - DNA, 708 bp, Homo sapiens
atgtacaggatgcaactcctgtcttgcattgcactaagtcttgcacttgtcacgaattcgcactctgagcagaatcggcagcgcgccgggagggaaagagcggagcgaagggtgaacatctccggcgctgggagcagcacaaaaaaaggaacaggtaacgatgtcccctggtaccagcagcccccagacacagcccccaaactcatgatttatgaggtcagtaatcggccctcaggggtccctgatcgcttctcggggtccaagtctggcaccacggcctccctgaccatctcggggctgcaggctgaggacgaggccgattattactgcggcttgtatccaagtagtactgtggttttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 35 - protein, 472 aa, Homo sapiens
MYRMQLLSCIALSLALVTNSEVQLVESGGGLVQAGGSLRLSCAASGFSFSSTYMSWVRQAPERGLEWVSNIYTDGAAHYTDSVKGRFTISRDNSKNTLYLQMESLRPEDTAVYYCTKVITGYSSGWRPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - DNA, 1419 bp, Homo sapiens
atgtacaggatgcaactcctgtcttgcattgcactaagtcttgcacttgtcacgaattcggaggtgcaactggtggagtctgggggaggcttggtccaggctggggggtccctgagactctcctgtgcagcctctggattcagcttcagtagcacctatatgagttgggtccgccaggctccagagagggggctggagtgggtttcaaatatttataccgatggtgcggcacactacacagactccgtgaagggccgattcaccatctccagagacaattccaagaacacgctgtaccttcaaatggaaagcctgcgacctgaggacacggctgtgtattactgtacgaaagttatcaccgggtacagcagtggctggcgcccatttgactactggggccagggaaccctggtcaccgtctcctcagctagcaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 37 - protein, 235 aa, Homo sapiens
MYRMQLLSCIALSLALVTNSQSALTQPASVSGSPGLSITISCTGTSGDVGSYKSVSWYQQHPGKAPKLIIYDVNKRPSGVSDRFSGSKSGNTASLTISGLQAEDEADYYCSSYTSTNTLFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 38 - DNA, 708 bp, Homo sapiens
atgtacaggatgcaactcctgtcttgcattgcactaagtcttgcacttgtcacgaattcgcagtctgccctgactcagcctgcctccgtgtctgggtctcctggactgtcgatcaccatctcctgcactggaaccagcggcgacgttggtagttataagtctgtctcctggtaccaacaacacccaggcaaagcccccaaactcatcatttatgatgtcaataagcggccctcaggggtgtctgatcgcttctctggctccaagtctggcaacacggcctccctgaccatctctgggctccaggctgaggacgaggctgattattactgcagctcatacacaagcaccaacactttattcggcggagggaccaaggtgaccgtcctgggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 39 - DNA, 30 bp, Homo sapiens
ggtgtctccatcagaaatagtaattacttc

SEQ ID NO: 40 - DNA, 21 bp, Homo sapiens
atgcatagtggtgggaccacc

SEQ ID NO: 41 - DNA, 42 bp, Homo sapiens
gcgagagatgacccccttaaccggttcgctgcttttcaaatc

SEQ ID NO: 42 - DNA, 24 bp, Homo sapiens
agctccaacattgggaataaatat

SEQ ID NO: 43 - DNA, 9 bp, Homo sapiens
gacaataat

SEQ ID NO: 44 - DNA, 36 bp, Homo sapiens
ggaacatgggatagcagcctgagtgttttttatgtc

SEQ ID NO: 45 - DNA, 24 bp, Homo sapiens
ggttacacctttaccagctatggt

SEQ ID NO: 46 - DNA, 24 bp, Homo sapiens
atcaacacttacaatggtaacaca

SEQ ID NO: 47 - DNA, 54 bp, Homo sapiens
gcgagagtcgctgtaggatattgcagtggtggtagctgctactactttgactac

SEQ ID NO: 48 - DNA, 18 bp, Homo sapiens
cagagtgttagcaacaac

SEQ ID NO: 49 - DNA, 9 bp, Homo sapiens
ggtgcatcc

SEQ ID NO: 50 - DNA, 33 bp, Homo sapiens
cagcagtataatgactggcctccgtcttggacg

SEQ ID NO: 51 - DNA, 24 bp, Homo sapiens
ggattcaccttcagtagctatgct

SEQ ID NO: 52 - DNA, 24 bp, Homo sapiens
atatcatatgatggaagtaataaa

SEQ ID NO: 53 - DNA, 42 bp, Homo sapiens
gcgagagaagggaatatagtggctacgatttctctggactac

SEQ ID NO: 54 - DNA, 27 bp, Homo sapiens
agctccaacatcggggcaggttatgat

SEQ ID NO: 55 - DNA, 9 bp, Homo sapiens
ggtaacagc

SEQ ID NO: 56 - DNA, 30 bp, Homo sapiens
cagtcctatgacagcagcctgagtgtggta

SEQ ID NO: 57 - DNA, 24 bp, Homo sapiens
ggattcacctttgctgattacgcc

SEQ ID NO: 58 - DNA, 24 bp, Homo sapiens
atcagttggaatagtggtaacata

SEQ ID NO: 59 - DNA, 42 bp, Homo sapiens
gtaaaggcctcaaccctctactactatttctacatggatgtc

SEQ ID NO: 60 - DNA, 27 bp, Homo sapiens
agcagtgacgttggtggttatgactat

SEQ ID NO: 61 - DNA, 9 bp, Homo sapiens
gaggtcagt

SEQ ID NO: 62 - DNA, 30 bp, Homo sapiens
tgctcatatgcaggcagcaacaattatgtc

SEQ ID NO: 63 - DNA, 24 bp, Homo sapiens
ggattcaccctcagtagcttcgac

SEQ ID NO: 64 - DNA, 21 bp, Homo sapiens
attggtactgctggtgacaca

SEQ ID NO: 65 - DNA, 63 bp, Homo sapiens
gcaagagggacctggctccgagattacaatttttggagtggttataattactactttgactac

SEQ ID NO: 66 - DNA, 27 bp, Homo sapiens
agcagtgacgttggtggttatatctat

SEQ ID NO: 67 - DNA, 9 bp, Homo sapiens
gaggtcagt

SEQ ID NO: 68 - DNA, 30 bp, Homo sapiens
agctcatatgcagacagcaacaattatgtc

SEQ ID NO: 69 - DNA, 24 bp, Homo sapiens
ggtgggtccttcagtggttactac

SEQ ID NO: 70 - DNA, 21 bp, Homo sapiens
atcaatcatagtggaagcacc

SEQ ID NO: 71 - DNA, 60 bp, Homo sapiens
gcgaggcaaagggggcaacgtattactatggttcggctaaaacgggactggttcgacccc

SEQ ID NO: 72 - DNA, 24 bp, Homo sapiens
agctccaacatcggaagtaatact

SEQ ID NO: 73 - DNA, 9 bp, Homo sapiens
agtaataat

SEQ ID NO: 74 - DNA, 33 bp, Homo sapiens
gcagcatgggatgacagcctgaatggtcctgta

SEQ ID NO: 75 - DNA, 24 bp, Homo sapiens
ggttacacctttaccagctatggt

SEQ ID NO: 76 - DNA, 24 bp, Homo sapiens
atcaacacttacaatggtaacaca

SEQ ID NO: 77 - DNA, 54 bp, Homo sapiens; identical to SEQ ID NO: 47

SEQ ID NO: 78 - DNA, 24 bp, Homo sapiens
agttccaatatgggaagtaatttt

SEQ ID NO: 79 - DNA, 9 bp, Homo sapiens
agaaataat

SEQ ID NO: 80 - DNA, 33 bp, Homo sapiens
gcagcatgggatgacagcctgaatggtgtggtc

SEQ ID NO: 81 - DNA, 24 bp, Homo sapiens
ggatacagctttaccagctactgg

SEQ ID NO: 82 - DNA, 24 bp, Homo sapiens
atctatcctggtgactctgatacc

SEQ ID NO: 83 - DNA, 42 bp, Homo sapiens
gcgaggggcgattgtagtagtaccagctgctaccttgactac

SEQ ID NO: 84 - DNA, 27 bp, Homo sapiens
agcacaaaaaaaggaacaggtaacgat

SEQ ID NO: 85 - DNA, 9 bp, Homo sapiens
gaggtcagt

SEQ ID NO: 86 - DNA, 27 bp, Homo sapiens
ggcttgtatccaagtagtactgtggtt

SEQ ID NO: 87 - DNA, 24 bp, Homo sapiens
ggattcagcttcagtagcacctat

SEQ ID NO: 88 - DNA, 21 bp, Homo sapiens
atttataccgatggtgcggca

SEQ ID NO: 89 - DNA, 48 bp, Homo sapiens
acgaaagttatcaccgggtacagcagtggctggcgcccatttgactac

SEQ ID NO: 90 - DNA, 27 bp, Homo sapiens
agcggcgacgttggtagttataagtct

SEQ ID NO: 91 - DNA, 9 bp, Homo sapiens
gatgtcaat

SEQ ID NO: 92 - DNA, 27 bp, Homo sapiens
agctcatacacaagcaccaacacttta

SEQ ID NO: 93 - DNA, 24 bp, Homo sapiens
ggttatacctttaccagctatgga

SEQ ID NO: 94 - DNA, 24 bp, Homo sapiens
attaatacttacaatgggaacaca

SEQ ID NO: 95 - DNA, 54 bp, Homo sapiens
gcgcgcgtcgctgtaggctattgcagtggtggcagctgctactacttcgattac

SEQ ID NO: 96 - DNA, 18 bp, Homo sapiens
cagagtgttagcaacaac

SEQ ID NO: 97 - DNA, 9 bp, Homo sapiens
ggtgcatcc

SEQ ID NO: 98 - DNA, 33 bp, Homo sapiens; identical to SEQ ID NO: 50

SEQ ID NO: 99 - protein, 120 aa, Homo sapiens
QVQLQESGSGLVKPSQTLSLTCAVSGVSMSTGDYSWSWIRRPPGKGLEWIGYIFLGGRTYSNPSLKSRVTMSIDRSKNQFSLKLTSVTAADTAVYYCARDRSGSGTLDYWGQGTLIAVSS

SEQ ID NO: 100 - DNA, 360 bp, Homo sapiens
caagtgcagctgcaggagtccggctccggactggtgaagccttcacagaccctgtccctcacctgcgctgtctctggtgtctccatgagcactggtgattactcctggagctggatccggcggccaccagggaagggcctggagtggattggttacatcttcctaggtgggagaacctactccaacccgtccctcaagagtcgagtcacaatgtcaatagacaggtccaagaaccagttctccctgaagctgacctctgtgaccgccgcggacacggccgtatattactgtgccagagatcgctctggttcggggacccttgactactggggccagggaaccctgatcgccgtctcctca

SEQ ID NO: 101 - protein, 109 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLFGGGTKLTVL

SEQ ID NO: 102 - DNA, 327 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctattcggcggagggaccaagctgaccgtccta

SEQ ID NO: 103 - DNA, 30 bp, Homo sapiens
ggtgtctccatgagcactggtgattactcc

SEQ ID NO: 104 - DNA, 21 bp, Homo sapiens
atcttcctaggtgggagaacc

SEQ ID NO: 105 - DNA, 36 bp, Homo sapiens
gccagagatcgctctggttcggggacccttgactac

SEQ ID NO: 106 - DNA, 27 bp, Homo sapiens
agcagtgacgttggtggttataactat

SEQ ID NO: 107 - DNA, 9 bp, Homo sapiens
gaggtcagt

SEQ ID NO: 108 - DNA, 27 bp, Homo sapiens
agctcatatacaagcagcagcactcta

SEQ ID NO: 109 - protein, 121 aa, Homo sapiens
EEQLLESGGDLVWPGGSLRLSCAASGLTFSSYSTNWVRQAPGRGLEWVASISSTSWSRYYADSVKGRFTISRDNAKNSLYLQMNSLGVEDTAVYYCTADQRARNTGVIDYWGRGTLVTVSS

SEQ ID NO: 110 - DNA, 363 bp, Homo sapiens
gaggagcagctgttggagtctgggggagacctggtctggcctggggggtccctgagactctcctgtgcagcctctggactcaccttcagtagctatagcacgaactgggtccgccaggctccagggagggggctggagtgggtcgcgtccattagtagtactagttggtccagatattacgcagactcagtgaagggccgattcaccatctccagagacaacgccaagaactcgctgtatctgcaaatgaacagcctgggagtcgaggatacggctgtgtattactgtacggcagatcagagagctcgaaacacgggggtcattgactattggggccggggaaccctggtcaccgtctcctca

SEQ ID NO: 111 - protein, 111 aa, Homo sapiens
QSALTQPASVSGSPGQSITISCTGTSSDIGGYDYVSWYRQDPGKAPRLMIYEVSNRPSGVSNRFSGAKSGNTASLTISGLQAEDEADYYCSSYSSTSTSVVFGGGTKLTVL

SEQ ID NO: 112 - DNA, 333 bp, Homo sapiens
cagtctgccctgactcagcctgcctccgtgtctgggtctcctggacagtcgatcaccatctcctgcactggaaccagcagtgacattggtggttatgactatgtctcgtggtaccgacaggacccaggcaaggcccccagactcatgatttatgaggtcagtaaccggccctcaggggtttctaatcgcttctctggcgccaagtctggcaacacggcctccctgaccatctctggcctccaggctgaggacgaggctgattattactgcagctcatattcaagcaccagcacctctgtggtgttcggcggagggaccaagctgaccgtccta

SEQ ID NO: 113 - DNA, 24 bp, Homo sapiens
ggactcaccttcagtagctatagc

SEQ ID NO: 114 - DNA, 24 bp, Homo sapiens
attagtagtactagttggtccaga

SEQ ID NO: 115 - DNA, 42 bp, Homo sapiens
acggcagatcagagagctcgaaacacgggggtcattgactat

SEQ ID NO: 116 - DNA, 27 bp, Homo sapiens
agcagtgacattggtggttatgactat

SEQ ID NO: 117 - DNA, 9 bp, Homo sapiens
gaggtcagt

SEQ ID NO: 118 - DNA, 33 bp, Homo sapiens
agctcatattcaagcaccagcacctctgtggtg

SEQ ID NO: 119 - protein, 126 aa, Homo sapiens
QLQLQESGSGLVKPSQTLSLTCAVSGGSVSSGGYSWSWIRQPPGKGLEWIGYIYDSGITSYNPSLKSRLTISIDRSKNQFSLGLSSVTAADTAVYYCARVRRNTSGSFSTGHFDYWGQGTLVTVSS

SEQ ID NO: 120 - DNA, 378 bp, Homo sapiens
cagctgcagctgcaggagtccggctcaggactggtgaagccttcacagaccctgtccctcacctgcgctgtctctggtggctccgtcagcagtggtggttattcctggagctggatccggcagccaccagggaagggcctggagtggattgggtacatctatgatagtgggatcacctcctacaacccgtccctcaagagccgactcaccatatcaatagacaggtccaagaaccagttctccctggggctgagctctgtgaccgccgcggacacggccgtgtattactgtgccagagttcggcggaatactagtggttctttctcgaccggccactttgactactggggccagggaaccctagtcaccgtctcctca

SEQ ID NO: 121 - protein, 111 aa, Homo sapiens
QSALTQPASVSGSPGQSITISCTGTSSDVGAYNYVSWYQHHPGKAPKLMIYDVSDRPSGVSNRFSGSKSGNTASLTISGLQAEDEADYYCSSYTNTSTLYVFGTGTKVTVL

SEQ ID NO: 122 - DNA, 333 bp, Homo sapiens
cagtctgccctgactcagcctgcctccgtatctgggtctcctggacagtcgatcaccatctcctgcactggaaccagcagtgacgttggtgcttataactatgtctcttggtaccaacaccacccaggcaaagcccccaaactcatgatttatgatgtcagtgatcggccctcaggagtttctaatcgcttctctggctccaagtctggcaacacggcctccctgaccatctctgggctccaggctgaggacgaggctgattattactgcagctcatatacaaacaccagcactctttatgtcttcggaactgggaccaaggtcaccgtccta

SEQ ID NO: 123 - DNA, 30 bp, Homo sapiens
ggtggctccgtcagcagtggtggttattcc

SEQ ID NO: 124 - DNA, 21 bp, Homo sapiens
atctatgatagtgggatcacc

SEQ ID NO: 125 - DNA, 54 bp, Homo sapiens
gccagagttcggcggaatactagtggttctttctcgaccggccactttgactac

SEQ ID NO: 126 - DNA, 27 bp, Homo sapiens
agcagtgacgttggtgcttataactat

SEQ ID NO: 127 - DNA, 9 bp, Homo sapiens
gatgtcagt

SEQ ID NO: 128 - DNA, 33 bp, Homo sapiens
agctcatatacaaacaccagcactctttatgtc

SEQ ID NO: 129 - protein, 126 aa, Homo sapiens; identical to SEQ ID NO: 119

SEQ ID NO: 130 - DNA, 378 bp, Homo sapiens; identical to SEQ ID NO: 120

SEQ ID NO: 131 - protein, 110 aa, Homo sapiens
QSVLTQPPSVSASPGQTVTISCSGSTSNIGGNYVSWYQHLPGTAPKLLIYDSNKRPSGIPDRFSGSKSGTSATLGITGLQTEDEADYYCGTWDYRLSGAVFGGGTKLTVL

SEQ ID NO: 132 - DNA, 330 bp, Homo sapiens
cagtctgtgctgacgcagccgccctcagtgtctgcgtccccaggacaaacggtcaccatctcctgctctggaagcacctccaacattggtggtaattatgtctcctggtaccagcacctcccaggaacagcccccaaactcctcatttatgacagtaataagcgaccctcagggattcctgaccgattctctggctccaagtctggcacgtcagccaccctgggcatcaccggactccagactgaggatgaggccgattattactgtggaacatgggattacagactgagtggtgcggtcttcggaggagggaccaagctgaccgtccta

SEQ ID NO: 133 - DNA, 30 bp, Homo sapiens; identical to SEQ ID NO: 123

SEQ ID NO: 134 - DNA, 21 bp, Homo sapiens
atctatgatagtgggatcacc

SEQ ID NO: 135 - DNA, 54 bp, Homo sapiens; identical to SEQ ID NO: 125

SEQ ID NO: 136 - DNA, 24 bp, Homo sapiens
acctccaacattggtggtaattat

SEQ ID NO: 137 - DNA, 9 bp, Homo sapiens
gacagtaat

SEQ ID NO: 138 - DNA, 33 bp, Homo sapiens
ggaacatgggattacagactgagtggtgcggtc

SEQ ID NO: 139 - protein, 116 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGVGDYAVWGQGTLVTVSS

SEQ ID NO: 140 - DNA, 348 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaggagtgggtgactacgcggtctggggccagggaaccctggtcaccgtctcctca

SEQ ID NO: 141 - protein, 111 aa, Homo sapiens
QSALTQPASVSGSPGQSITISCTGTNSDIGGYDYVSWYQQHPGKAPKLMIFDVNNRPSGVSNRFSGSKSGNTASLTISELQSADEADYFCSSFSTRNSLVVFGGGTKLTVL

SEQ ID NO: 142 - DNA, 333 bp, Homo sapiens
cagtctgccctgactcagcctgcctccgtgtctgggtctcctggacagtcgatcaccatctcctgcactggaaccaacagtgacattggtggttatgattatgtctcctggtaccaacaacacccaggcaaagcccccaaactcatgatttttgacgtcaataatcggccctcaggggtttctaatcgcttctctggctccaagtctggcaacacggcctccctgaccatctctgagctccagtctgcggacgaggctgattatttctgcagctctttttcaaccagaaactctctcgtggtgttcggcggagggaccaaactgaccgtccta

SEQ ID NO: 143 - DNA, 24 bp, Homo sapiens
ggattcaccttcagtagctatggc

SEQ ID NO: 144 - DNA, 24 bp, Homo sapiens
atatcatatgatggaagtaataaa

SEQ ID NO: 145 - DNA, 27 bp, Homo sapiens
gcgaaaggagtgggtgactacgcggtc

SEQ ID NO: 146 - DNA, 27 bp, Homo sapiens
aacagtgacattggtggttatgattat

SEQ ID NO: 147 - DNA, 9 bp, Homo sapiens
gacgtcaat

SEQ ID NO: 148 - DNA, 33 bp, Homo sapiens
agctctttttcaaccagaaactctctcgtggtg

SEQ ID NO: 149 - protein, 126 aa, Homo sapiens; identical to SEQ ID NO: 119

SEQ ID NO: 150 - DNA, 378 bp, Homo sapiens; identical to SEQ ID NO: 120

SEQ ID NO: 151 - protein, 110 aa, Homo sapiens
QSVLTQPPSVSAVPGQKVTISCSGNNSNIGNNLVSWYQQLPGTAPKLLIYNNNRRPSGIPDRFSGSKSGTSATLGITGLQTGDEAAYYCAARDSSLSAVVFGGGTKLTVL

SEQ ID NO: 152 - DNA, 330 bp, Homo sapiens
cagtctgtgttgacgcagccgccctcagtgtctgcggtcccaggacagaaggtcaccatctcctgctctggaaacaactccaatattggaaataatcttgtatcctggtaccagcagctcccaggaacagcccccaaactcctcatttataacaataataggcgaccatcagggattcctgaccgattctctggctccaagtctggcacgtcagccaccctgggcatcaccggactccagactggggacgaggccgcttattattgcgcagcaagggatagcagcctgagtgctgtggtgttcggcggagggaccaaactgaccgtccta

SEQ ID NO: 153 - DNA, 30 bp, Homo sapiens; identical to SEQ ID NO: 123

SEQ ID NO: 154 - DNA, 21 bp, Homo sapiens
atctatgatagtgggatcacc

SEQ ID NO: 155 - DNA, 54 bp, Homo sapiens; identical to SEQ ID NO: 125

SEQ ID NO: 156 - DNA, 24 bp, Homo sapiens
aactccaatattggaaataatctt

SEQ ID NO: 157 - DNA, 9 bp, Homo sapiens
aacaataat

SEQ ID NO: 158 - DNA, 33 bp, Homo sapiens
gcagcaagggatagcagcctgagtgctgtggtg

SEQ ID NO: 159 - protein, 120 aa, Homo sapiens
EVQLVESGGGLVQPGGSLRLSCAASGFTLNNYWMHWVRQAPGKGPVWVSRINSDGSSTSYADSVKGRFTISRDNAKNTLFLQMNSLRAEDTAVYHCAREVRSAAGYFDYWGQGTLVTVSS

SEQ ID NO: 160 - protein, 107 aa, Homo sapiens
DIQMTQSPSSVSASVGDRVTITCRASQGISNWLTWYQHKPGTAPKLLIYGASSLQSGVPSRFSGSGSGTDFTLTISSLQPEDFATYYCQQANTFPLTFGGGTKVEIK

SEQ ID NO: 161 - protein, 122 aa, Homo sapiens
EVQLLESGGGLVQPGGSLRLSCAASGFIFSDYAMSWVRQAPGKGLEWVAVINNGGGSVYYADSVKGRFTISRDNSKNTLHLQMNSLRTDDTAVYYCAKFRGETHLVWYFDRWGRGTLVTVSS

SEQ ID NO: 162 - protein, 107 aa, Homo sapiens
DIQMTQSPSAMSASVGDRVTITCRATQGFSNYLAWFQQRPGKAPKRLIYATSTLHSGVPSRFSGSGSGTEFNLTISSLQPEDFATYYCLQHGRYPATFGQGTKLEIK

SEQ ID NO: 163 - protein, 120 aa, Homo sapiens
QVQLVQSGAEVMQVGASVKVSCTTSGFIFISHYMHWVRQAPGQGLEWMGIITPANTTKYSQRFQGRVTMTSDASTSTVYMELSSLRSEDTAVYYCAREWGELDSSVFDYWGQGTLVTVSA

SEQ ID NO: 164 - protein, 111 aa, Homo sapiens
QSVLTQPPSVSGAPGQRVTISCNGSSSNIGAGYDVHWYQHFPGSAPKLLMYGNKNRPSGVPDRISASKSDSSASLAITGLRGEDEADYYCQSYDNSLSVWVFGGGTKLTVL

SEQ ID NO: 165 - protein, 112 aa, Homo sapiens
QVQLQESGPGLVKPSETLSLTCTVSGGSISSYYWNWIRQPPGKGLEWIGYIYYSGSTNYNPSLKSRVTISVDTSKKQFSLKLSSVTAADTAVYYCARKFEQWGQGTLVTVSS

SEQ ID NO: 166 - protein, 108 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPTWTFGQGTKVEIK

SEQ ID NO: 167 - protein, 119 aa, Homo sapiens
EVQLIQSGSEIKKPGESLKISCKGSGYRFSAYWLAWVRQMPGKGLECMGVIYPGDSDTIYNPAFVGQVTISADKSTNTAYLQWSSLKASDTATYYCARQQGVQLWFANWGRGTLVTVSS

SEQ ID NO: 168 - protein, 107 aa, Homo sapiens
DIQMTQSPSTLSASVGDRVSITCRASQSISSWLAWYQQKPGKAPNLLIYTASNLESGVPARFSGSGSGTEFTLTISSLQPDDFATYYCQQYNTYPWTFGQGTKVEVK

SEQ ID NO: 169 - protein, 119 aa, Homo sapiens
QVQLVQSGAEVKRPGASVKISCKTSGYTFTNYAVHWLRQAPGQGLEWMGWINGGTGHTKYSRKFQGRVTITRDTSASTAYMEVHSLRSEDTAVFYCAGSPTYYSWFDPWGQGTQVIVSS

SEQ ID NO: 170 - protein, 109 aa, Homo sapiens
QAVVTQEPSLTVSPGGTVTLTCASSTGAVTSGYYPNWFQQKPGQAPRALIYSTSNKHSWTPARFSGSLLGGKAALTLSGVQPEDEAEYYCLLYYGGAWVFGGGTKLTVL

SEQ ID NO: 171 - protein, 118 aa, Homo sapiens
EVQLLESGGGLVQPGGSLRLSCAASGFTFSSYGMSWVRQAPGKGLEWVSSISGSGDRIYGVDSLKGRFTISRDNSKNTLYLQMNSLRAEDTAVYYCARRPLGSRFDLWGRGTLVTVSS

SEQ ID NO: 172 - protein, 110 aa, Homo sapiens
QSALTQPPSVSGSPGQSITITCTGTSSDVGGYQYVSWYQQHPGKAPKVIIYDVSYRPSGFSNRFSGSKSGNTASLTISGLQTEDEAEYYCSSYTRSGTYVFGTGTEVTVL

SEQ ID NO: 173 - protein, 122 aa, Homo sapiens
EVQLLESEGGLVQPGGSLRLSCAASGFIFSDYAMSWVRQAPGKGLEWVAVINNGGGSVYYADSVKGRFTISRDNSKNTLHLQMNSLRTDDTAVYYCAKFRGETHLVWYFDRWGRGTLVTVSS

SEQ ID NO: 174 - protein, 108 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSPWTFGPGTKVDIK

SEQ ID NO: 175 - protein, 121 aa, Homo sapiens
QLQLQESGPGLVKPSETLSLTCTVSRGSISSSAYYWGWVRQPPGKGLEWIGSINYNGNTYYTSSLKSRLTISVDTSRNQFSLKLSSVTAADTAVYYCARIIISGSNWFDPWGQGTLVTVSS

SEQ ID NO: 176 - protein, 109 aa, Homo sapiens; identical to SEQ ID NO: 170

SEQ ID NO: 177 - protein, 119 aa, Homo sapiens; identical to SEQ ID NO: 167

SEQ ID NO: 178 - protein, 107 aa, Homo sapiens
EIVMTQSPATLSVSPGERATLSCRASQSVGNSLAWYQQKPGQPPRLLIYDASTRATGIPASFSGIGSGTEFTLTISSLQPEDFAAYHCQQYYNWPLTFGGGTKVEIK

SEQ ID NO: 179 - protein, 120 aa, Homo sapiens
EVQLVQSGAEVKNLGESLKISCKASGYTFTSYWIGWVRQMPGKGLEYMGIVYPGGSDTRYSPSFQGQVTISADKSISTAYLQWNTLKASDTAMYYCVRAAYGLGGITGPWGQGTLVTVSS

SEQ ID NO: 180 - protein, 110 aa, Homo sapiens
QSALTQPPSVSGSPGQSITITCTGTSSDVGGYQYVSWYQQHPGKAPKVIIYDVSYRPSGVSNRFSGSKSGNTASLTISGLQTEDEAEYYCSSYTRSGTYVFGTGTEVTVL

SEQ ID NO: 181 - protein, 123 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKAGTYYYDSSGYTHYWGQGTLVTVSS

SEQ ID NO: 182 - protein, 108 aa, Homo sapiens; identical to SEQ ID NO: 166

SEQ ID NO: 183 - protein, 119 aa, Homo sapiens
EVQLVQSGAEVKKPGESLRISCQGSGYSFTTYWITWVRQMPGKGLEWMGRSDPSDSYSNYSPSFQGRVIMSFEKSTNTAYLQWTSLKASDTAIYYCARHDISGFYLPNWGQGTLVTVSS

SEQ ID NO: 184 - protein, 107 aa, Homo sapiens
DVQMTQSPSTLSASVGDRVTITCRASQSITSRLAWYQQKPGKAPKVLIYKASSLESGVPSRFSGSGSGTEFTLTISSLQPDDFATYYCQQYNSYSLTFGQGTKVEIK

SEQ ID NO: 185 - protein, 119 aa, Homo sapiens
EVQLVQSGAEVKKPGESLKISCKGSGYRFTNYWIGWVRQMPGKGLEWMGIIYPDESDTRYSPSFQGQVTISAVKSISTAYLQWRSLKASDTAMYYCARQTDGKSWLDPWGQGTLVTVSS

SEQ ID NO: 186 - protein, 107 aa, Homo sapiens; identical to SEQ ID NO: 184

SEQ ID NO: 187 - protein, 119 aa, Homo sapiens; identical to SEQ ID NO: 185

SEQ ID NO: 188 - protein, 110 aa, Homo sapiens
QSVLTQPPSVSAAPGQKVTISCSGSDSNIGKNYVCWYQSLPGTAPKLLMFDNSKRPSGIPDRFSASKSGTSAALVITGLQTGDEADYYCGTWDSSLYAGVFGGGTRLTVL

SEQ ID NO: 189 - protein, 120 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTLTNMDPVDTATYYCAHRGPVAGHFGFWGQGTLVTVSS

SEQ ID NO: 190 - protein, 110 aa, Homo sapiens; identical to SEQ ID NO: 188

SEQ ID NO: 191 - protein, 121 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARVLNISWADAFDIWGQGTMVTVSS

SEQ ID NO: 192 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPYTFGQGTKLEIK

SEQ ID NO: 193 - protein, 119 aa, Homo sapiens
QMQLVESGGGVVQPGRSLRLSCAVSGFTFSNYGMNWVRQAPGKGLEWVADISFDGSERHYADSVKGRFTISRDNSKNTLYLQMNNLRAEDTAVYYCAKPLIAARPPDSWGQGTLVTVSS

SEQ ID NO: 194 - protein, 110 aa, Homo sapiens; identical to SEQ ID NO: 188

SEQ ID NO: 195 - protein, 122 aa, Homo sapiens; identical to SEQ ID NO: 161

SEQ ID NO: 196 - protein, 107 aa, Homo sapiens; identical to SEQ ID NO: 168

SEQ ID NO: 197 - protein, 117 aa, Homo sapiens
EVQLMQSGAQMKKPGESLKISCQGSGYNFPNSWIAWVRQMPGKGLEYMGIIYASNSDTRYSPSFQGQVSISVDKSISTAYLQWSSLKASDTAMYYCARRADYAFDHWGQGTLVTVSS

SEQ ID NO: 198 - protein, 110 aa, Homo sapiens; identical to SEQ ID NO: 188

SEQ ID NO: 199 - protein, 118 aa, Homo sapiens
EVQLLESGGGLVQPGGSLRLSCAASGFTFSSYGMSWVRQAPGKGLEWVSSISGSGDKIYGVDSLKGRFTISRDNSKNTLYLQMNSLRAEDTAVYYCARRPLGSRFDLWGRGTLVTVSS

SEQ ID NO: 200 - protein, 107 aa, Homo sapiens [sequence omitted]

SEQ ID NO: 201 - protein, 120 aa, Homo sapiens; identical to SEQ ID NO: 189

SEQ ID NO: 202 - protein, 104 aa, Homo sapiens
EIVLTQSPGTLSLSPGERAALSCRASQSLSSTYLAWYQQKPGQAPRLLIYAASSRATGIPDRFSGSGSGTDFTLTIRRLEPEDFAVYYCQHFGTFGQGTTVEIK

SEQ ID NO: 203 - protein, 122 aa, Homo sapiens
EVQLVESGGGLVKPGGSLRLSCAASGFTFNSYSMNWVRQAPGKGLEWVSSITSSSSYIYYADSVKGRFTISRDNAKNSLYLQMNSLRADDTAVYYCARASKQYYYYYYMDVWGKGTTVTVSS

SEQ ID NO: 204 - protein, 108 aa, Homo sapiens
VIVLTQSPGTLSLSPGDRGTLSCTASQFVRNRDLAWYQQKPGQAPRLLIYGASRRATGIPDRFSGGGSGTDFTLTISRLEPEDCAVYFCLQYASSPMTFGQGTKVEIK

SEQ ID NO: 205 - protein, 118 aa, Homo sapiens; identical to SEQ ID NO: 171

SEQ ID NO: 206 - protein, 107 aa, Homo sapiens; identical to SEQ ID NO: 168

SEQ ID NO: 207 - protein, 117 aa, Homo sapiens; identical to SEQ ID NO: 197

SEQ ID NO: 208 - protein, 104 aa, Homo sapiens; identical to SEQ ID NO: 202

SEQ ID NO: 209 - protein, 119 aa, Homo sapiens
QVQLVQSGAEVMQVGASVKVSCKASEFTFTTYHLHWVRQAPGQGLEWMGIISPTGGSATYAQKFQGRVTMTRDTSTRTVYMELSSLRSEDTAVYFCARDLGGSYYFDYWGQGTLVTVSS

SEQ ID NO: 210 - protein, 107 aa, Homo sapiens
EIVLTQSPATLSLSPGERATLSCRASQSLSTYLAWYQQKPGQAPRLLIYDASNRATGIPARFSGSGSGTDFSLTISSLEPEDFAVYYCQQRSDWPRTFGQGTKLEIK

SEQ ID NO: 211 - protein, 122 aa, Homo sapiens
QVQLQESGPRLVKPSQTLSLTCTVSGGSMTRGYFYWSWIRQHPGKGLEWIGSIYHSGTTFYNASLQSRLAMSIDTSSKQFSLMLTSVTAADTAIYFCARDRTSVVGGGMDPWGQGILVTVST

SEQ ID NO: 212 - protein, 110 aa, Homo sapiens
EIVLTQSPATLSLSPGDSATLSCRATHSVSSSYLTWYQQKPGQAPRLLIYGTSIRATGVPARFSGSGSGTDFTLTISRLEAEDFAVYYCQRYSNSPPMYAFGQGTQLTIK

SEQ ID NO: 213 - protein, 121 aa, Homo sapiens
QVQLVESGGGVAQPGTSLRLSCEGSGFMFSGHGMHWVRQAPGKGLEWVAVVSAAGGTQYYAESVKGRFTISRDNSRNTMTLQMNSLRPDDTALYYCTKEGDDSAYLAFDIWGQGTMVTVSS

SEQ ID NO: 214 - protein, 109 aa, Homo sapiens
ETVLTQSPATLSLSPGERATLSCRASQSIANNLAWYRQKPGQPPRLLIYGASTRATGVPARLTGSGSGTDFTLTITSLEPEDFAVYYCQHRSHWPPGGTFGQGTKLEIK

SEQ ID NO: 215 - protein, 120 aa, Homo sapiens; identical to SEQ ID NO: 179

SEQ ID NO: 216 - protein, 107 aa, Homo sapiens; identical to SEQ ID NO: 184

SEQ ID NO: 217 - protein, 122 aa, Homo sapiens
QVQLVESGGGVVPPGRSLRLSCEGLGFIFSDYTMAWVRQAPGKGLEWGALISHDGSTKRSADSVEGRFSISRDNSKNLVHLHMDSLRAEDTAVYFCVRDHFLRLIREIWDNWGQGTQVTVSS

SEQ ID NO: 218 - protein, 111 aa, Homo sapiens
QSVLTQPPSVSGAPGQRVTISCNGSSSNIGAGYDVHRYQHFPGSAPKLLMYGNKNRPSGVPDRISASKSDSSASLAITGLRGEDEADYYCQSYDNSLSVWVFGGGTKLTVL

SEQ ID NO: 219 - protein, 119 aa, Homo sapiens
  misc_feature (106)..(106): Xaa can be any naturally occurring amino acid
EVQLIQSGSEIKKPGESLKISCKGSGYRFSAYWLAWVRQMPGKGLKCMGVIYPGDSDTIYNPAFVGQVTISADKSTNTAYLQWSSLKASDTATYYCARQQGVQLWXANWGRGTLVTVSS

SEQ ID NO: 220 - protein, 107 aa, Homo sapiens; identical to SEQ ID NO: 184

SEQ ID NO: 221 - protein, 119 aa, Homo sapiens; identical to SEQ ID NO: 185

SEQ ID NO: 222 - protein, 107 aa, Homo sapiens; identical to SEQ ID NO: 162

SEQ ID NO: 223 - protein, 118 aa, Homo sapiens; identical to SEQ ID NO: 171

SEQ ID NO: 224 - protein, 109 aa, Homo sapiens; identical to SEQ ID NO: 170

SEQ ID NO: 225 - protein, 117 aa, Homo sapiens
EVQLVESGGGLVQPGGSLRLSCAASGFSFNYDWMHWVRQAPGEGPVWVSCINGDGSTIRYGESVKGRFTISRDNAKNTLYLQMNSLRLEDTAVYFCVRGAGYILSYWGPGTVVTVSS

SEQ ID NO: 226 - protein, 107 aa, Homo sapiens
EVVLTQSPATLSFSPGERATLSCRASQYVSTSVSWYQHRPGQAPRLLFFDVSRRATGIPDRFNGSGSGTAFNLTISSLEPEDLAVYYCHQRYNWPATFGPGTKVEIK

SEQ ID NO: 227 - protein, 119 aa, Homo sapiens; identical to SEQ ID NO: 209

SEQ ID NO: 228 - protein, 109 aa, Homo sapiens [sequence omitted]

SEQ ID NO: 229 - protein, 117 aa, Homo sapiens; identical to SEQ ID NO: 225

SEQ ID NO: 230 - protein, 104 aa, Homo sapiens; identical to SEQ ID NO: 202

SEQ ID NO: 231 - protein, 119 aa, Homo sapiens; identical to SEQ ID NO: 167

SEQ ID NO: 232 - protein, 110 aa, Homo sapiens; identical to SEQ ID NO: 188

SEQ ID NO: 233 - protein, 118 aa, Homo sapiens; identical to SEQ ID NO: 171

SEQ ID NO: 234 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPQTFGQGTKVEIK

SEQ ID NO: 235 - protein, 117 aa, Homo sapiens; identical to SEQ ID NO: 225

SEQ ID NO: 236 - protein, 110 aa, Homo sapiens; identical to SEQ ID NO: 188

SEQ ID NO: 237 - protein, 121 aa, Homo sapiens
EVQLVQSGAEVKKPGESLRISCKGSGYSFTSYWINWVRQMPGKGLLEWVGRIDPTDSYTNYSPSFQGHVSISADKSISTAYLQWSSLKASDTAMYYCARHSDFWSGYPDVWGKGTTVTVSS

SEQ ID NO: 238 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSPTFGQGTKVEIK

SEQ ID NO: 239 - protein, 119 aa, Homo sapiens; identical to SEQ ID NO: 169

SEQ ID NO: 240 - protein, 107 aa, Homo sapiens; identical to SEQ ID NO: 162

SEQ ID NO: 241 - protein, 120 aa, Homo sapiens; identical to SEQ ID NO: 189

SEQ ID NO: 242 - protein, 107 aa, Homo sapiens; identical to SEQ ID NO: 168

SEQ ID NO: 243 - protein, 122 aa, Homo sapiens
QVQLVQSGAEVMQVGASVKVSCKASAYKSTTYGIIWARQAPGQGLEFMGWVTPHNGVTKYEQKFQDRITITTDTSTGTAYMEMRSLRFDDTAIYYCARFVDSDDYRGWLDPWGRGTLVTVSS

SEQ ID NO: 244 - protein, 107 aa, Homo sapiens; identical to SEQ ID NO: 226

SEQ ID NO: 245 - protein, 117 aa, Homo sapiens
EVQLVQSGVEVKKPGESLKISCKVSGYIFSTYWIGWVRQLPGKGLECMGIIFPSDSDTSYSAPFQGQVTISVDKSINTAYLQWSSLKASDTAMYFCARQDSRGIQYWGRGTLVTVSS

SEQ ID NO: 246 - protein, 107 aa, Homo sapiens
EIVLTQSPATLSLSPGERATLSCRSSQSVGRYLAWYQQKPGQAPRLLVYDSSARATGIPARFSGSGSETDFTLTINSLEPEDFAVYYCQQRSNWPLTFGGGTKVEFK

SEQ ID NO: 247 - protein, 117 aa, Homo sapiens; identical to SEQ ID NO: 197

SEQ ID NO: 248 - protein, 105 aa, Homo sapiens
DIQMTQSPSTVSASVGDRVTITCRASQSISSWLAWYQQKPGKAPKLLISRASRLESGVPSRFSGSGSGTEFTLTISSLQPDDCATYYCQQYNYYSFGQGTKVEIR

SEQ ID NO: 249 - protein, 120 aa, Homo sapiens; identical to SEQ ID NO: 189

SEQ ID NO: 250 - protein, 105 aa, Homo sapiens; identical to SEQ ID NO: 248

SEQ ID NO: 251 - protein, 119 aa, Homo sapiens
QITLKESGPTLVKPTQTLTLTCTFSGFSFTTTGVGVGWIRQPPGKALEWLALINWDDDKRYSPSLKSRLTITKDTSKNQVVLTMTNMDHADTATYYCAHRRPYPSFEYWGQGTLVTVSS

SEQ ID NO: 252 - protein, 107 aa, Homo sapiens
DIQLTQSPSFLSASIGDRVTITCRASQGISRFLAWYQQKPGKAPKLLIYGASNLQSGVPSRFSGSGSGTEFTLTINSLHPEDFATYYCQQLKSYPYTFGQGTKLDIK

SEQ ID NO: 253 - protein, 117 aa, Homo sapiens; identical to SEQ ID NO: 197

SEQ ID NO: 254 - protein, 107 aa, Homo sapiens; identical to SEQ ID NO: 162

SEQ ID NO: 255 - protein, 119 aa, Homo sapiens; identical to SEQ ID NO: 185

SEQ ID NO: 256 - protein, 109 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSPRVFGTGTKVTVL

SEQ ID NO: 257 - protein, 120 aa, Homo sapiens; identical to SEQ ID NO: 189

SEQ ID NO: 258 - protein, 108 aa, Homo sapiens
GIVLTQSPGTLSLSPGERATLSCRASQSVSSSYLAWYQQKPGQAPRLLIYGASSRGTGIPDRFSGSGSGTDFTLTISRLEPEDFAVYYCHQYGSSPFIFGPGTKVDIK

SEQ ID NO: 259 - protein, 121 aa, Homo sapiens
EVQLVESGGGWTGPGGSLRLSCVTSGFTFSSYEMTWVRQAPGRGLEYISYIDTDARRILYADSVKGRFAISRDDAKNSLYLQMNSLRAEDTAVYYCARDAEHNYGPVFDYWGQGILVSVSS

SEQ ID NO: 260 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLYTFGQGTKLEIK

SEQ ID NO: 261 - protein, 118 aa, Homo sapiens; identical to SEQ ID NO: 171

SEQ ID NO: 262 - protein, 107 aa, Homo sapiens; identical to SEQ ID NO: 178

SEQ ID NO: 263 - protein, 119 aa, Homo sapiens; identical to SEQ ID NO: 185

SEQ ID NO: 264 - protein, 108 aa, Homo sapiens
EIVMTQSPATLSVSPGERATLSCRASQSVSSNLAWYQQKPGQAPRLLIYGASTRATGIAARFSGSGSGTEFTLTISSLQSEDVAVYYCQQYNNWPVITFGPGTKVDIR

SEQ ID NO: 265 - protein, 119 aa, Homo sapiens; identical to SEQ ID NO: 185

SEQ ID NO: 266 - protein, 106 aa, Homo sapiens
EIVLTQSPATLSLSPGERATLSCRATESVGSYVAWYQQRPGQAPRLLIHDVSHRATGVPARFSGSGSETDFTLTISSLEPEDFAIYYCQQRTDLFTFGPGTKVEIT

SEQ ID NO: 267 - protein, 125 aa, Homo sapiens
QVQLQESGPGLVKPSQTLSVTCSVSGASITSDDYYWSWIRQSPGQGLEWIGYISNTGNTYYNPSLKSRLTISPDTSKNQISLMLTSVTAADTAVYFCVRVRREWQLPGGGCLDYWGQGALVTVSS

SEQ ID NO: 268 - protein, 110 aa, Homo sapiens
QSALTQPASVSGSPGQSITISCTGSSSNVGSYNLVSWYQQYPGEAPKLMIYEVTKRPSGVSTRFSGSKSGNTASLTISGLQAEDETDYYCCSYAGSSTYVFGTGTKVTVL

SEQ ID NO: 269 - protein, 122 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGIVPAAIYYGMDVWGQGTTVTVSS

SEQ ID NO: 270 - protein, 107 aa, Homo sapiens
DIQMTQSPSSLSASVGDRVTITCRASQTIFRFVNWYQHKPGRAPNVLIYAASSLRSGVPSRFSGAGSGTEFTLTISSLQPEDFATYYCQQSYTTPWTFGQGTHVDIK

SEQ ID NO: 271 - protein, 121 aa, Homo sapiens
EVQLVQSGAEVKKPGESLKISCQTSGYNFINYWIGWVRQMPGEGLEWMGIIYPGDSDSRYSPSFQGQVTISADKSINTAYLQWSSLKASDTAIYYCARLVDTAMINAFDIWGQGTMVIVSS

SEQ ID NO: 272 - protein, 107 aa, Homo sapiens
EIVLTQSPSTLSLSPGERATLSCRASQSVLSNYFAWYQQKHGQAPRLLIYGASRRATGIPDRFSGSGSGTDFALTISRLEPEDFAMYYCQLYGFSYPFGQGTKLEVK

SEQ ID NO: 273 - protein, 125 aa, Homo sapiens
QVQLVQSGAEVMQVGASVKVSCKASGYTFTSYGISWVRQAPGQGLEWMGWINTYNGNTNYAQKLQGRVTMTTDTSTTTAYMELRSLRSDDTAVYYCARVAVGYCSGGSCYYFDYWGQGTLVTVSS

SEQ ID NO: 274 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 275 - protein, 121 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLQWLRDGGDFDYWGQGTLVTVSS

SEQ ID NO: 276 - protein, 107 aa, Homo sapiens
ETVLTQSPGTLSLSPGERATLSCRASQSVSSSYLAWYQQKPGQAPRLLIYAASSRATGIPDRFSGSGSGTDFTLTISRLEPEDFAVYYCQQYGSSFTFGPGTKVEIK

SEQ ID NO: 277 - protein, 124 aa, Homo sapiens
QVQLQQWGAGLLKPSETLSLTCAVYGGSVSGYYWSWIRQPPGKGLQWIGEINHSGSTNYSPSLRSRVTILLDTSKKQFSLKLSSVTAADTAVYYCARGRSETYGVPERVRLDPWGQGTLVTVSS

SEQ ID NO: 278 - protein, 105 aa, Homo sapiens; identical to SEQ ID NO: 248

SEQ ID NO: 279 - protein, 117 aa, Homo sapiens; identical to SEQ ID NO: 197

SEQ ID NO: 280 - protein, 109 aa, Homo sapiens
EIVLTQSPATLSVSPGDRATLSCRASQSVSSNLAWYQQKPGQAPRLLIYGASTRATGIPARFSGSGSGTEFTLTISSLQSEDFAVYYCQQYNDWPPMYTFGQGTKLEIK

SEQ ID NO: 281 - protein, 125 aa, Homo sapiens; identical to SEQ ID NO: 267

SEQ ID NO: 282 - protein, 105 aa, Homo sapiens; identical to SEQ ID NO: 248

SEQ ID NO: 283 - protein, 122 aa, Homo sapiens
QVLLVESGGGLVKPGGSLRLSCTASGFTFSDYYMIWIRQAPGKGLEWISSISSRSTYIKYADSVKGRFTISRDNAKNSLYLQMNSLRVEDTAVYYCASGKQWLVGIYDFDSWGQGTLVTVSS

SEQ ID NO: 284 - protein, 107 aa, Homo sapiens
DIQMTQSPSSLSASVGDRVTITCRASHNIGIWLAWYQQKPGKGPKLLIHRASTLENGVPSRFSGSRSGTEFTLTITSLQPDDFATYYCQQYNSYLYTFGQGTKLEIK

SEQ ID NO: 285 - protein, 124 aa, Homo sapiens; identical to SEQ ID NO: 277

SEQ ID NO: 286 - protein, 107 aa, Homo sapiens; identical to SEQ ID NO: 284

SEQ ID NO: 287 - protein, 125 aa, Homo sapiens; identical to SEQ ID NO: 273

SEQ ID NO: 288 - protein, 105 aa, Homo sapiens; identical to SEQ ID NO: 248

SEQ ID NO: 289 - protein, 122 aa, Homo sapiens
EVQLVESGGGLVKPGGSLKLSCAASGFNLHSYTMNWVRQAPGKGLEWVSFITSDSRKTFYADSVRGRFTISRDNAKNSLFLQMNSLRAEDTAVYYCARGVEWDTSTNWFASWGQGTLVTVSS

SEQ ID NO: 290 - protein, 107 aa, Homo sapiens
EIVMTQSPATLSVSPGERATLSCRASQSVGNSLAWYQQKPGQPPRLLIYDASTRATGIPASFSGIGPGTEFTLTISSLQPEDFAAYHCQQYYNWPLTFGGGTKVEIK

SEQ ID NO: 291 - protein, 118 aa, Homo sapiens
QVQLQESGPGLVKPSGTLSLTCAVSGDSISSSHWWSWVRQPPGKGLEWIGEIYHSGSTNYNPSLKSRVTISRDKSKNHFSLKLNSVTAADTAVYFCARRPLNMMFDFWGQGTLVNVSS

SEQ ID NO: 292 - protein, 108 aa, Homo sapiens
EIVLTQSPATLSLSPGERATLSCRASRSVSTYLAWYQQKPGQAPRLLIYDASNRASGIPSRFSGSGSGTDFTLTISSLEPEDFAVYYCQQCYSGPPWTFGQGTKVENK

SEQ ID NO: 293 - protein, 121 aa, Homo sapiens
EVHLSESGGGLIHPGGSLRLSCAASGFSFRSYAMAWARQAPGKGLEWVSCINGVGGYIHYADSVRGRFTISRDNSINTLYLQMDSLRVEDTAVYYCAKWGPYSGSQYFEYWGQGTLLSVSS

SEQ ID NO: 294 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPLTFGGGTKVEIK

SEQ ID NO: 295 - protein, 120 aa, Homo sapiens; identical to SEQ ID NO: 189

SEQ ID NO: 296 - protein, 111 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGYWVFGGGTKLTVL

SEQ ID NO: 297 - protein, 120 aa, Homo sapiens
QINLKESGPPLVKPTQTLTLICTFSGFSLSTRGVYWGWIRHPPGKALEWIAFVYYTDDTRYNPSLKSRLTISVDTSKNQLSLKLSTVNAVDTAVYYCARGSKLAGHSGYWGQGTLVTVSS

SEQ ID NO: 298 - protein, 107 aa, Homo sapiens; identical to SEQ ID NO: 284

SEQ ID NO: 299 - protein, 118 aa, Homo sapiens
QVQLVQSGAEVMQVGASVRVSCKASGYTFISYGISWVRQAPGQGLEWMGWISAYNDNTKYAQKLQGRVTLTTDTSTSTAYMELRSLRSDDTAVYYCARDGGSYGWGYWGQGTLVTVSS

SEQ ID NO: 300 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 301 - protein, 120 aa, Homo sapiens; identical to SEQ ID NO: 159

SEQ ID NO: 302 - protein, 110 aa, Homo sapiens
EIVLTQSPATLSLSLGERATLSCRASQTVRSNYLAWYQQKPGLAPRLLIYDASIRVAGIPDRFTGSGSGTDFTLTISRLEPEDFAVYYCQQFGASPPALTFGGGTKVEIR

SEQ ID NO: 303 - protein, 120 aa, Homo sapiens; identical to SEQ ID NO: 159

SEQ ID NO: 304 - protein, 110 aa, Homo sapiens; identical to SEQ ID NO: 180

SEQ ID NO: 305 - protein, 119 aa, Homo sapiens
QVQLVQSGAEVREPGSSVKVSCKASGDTLSNSAISWVRQAPGQGLEWMGRIIPMFGMASYSQKFQGRITISADKSTRTVYMELSSLTSEDTAVYYCARGGGTWAPFDPWGQGTQLTVSS

SEQ ID NO: 306 - protein, 110 aa, Homo sapiens
QSVLTQPPSASGTPGQRVTISCSGSGSNIGNNFVYWYQQLPGTAPKLLIYRIDQRPSGVPDRFSGSKSGTSASLAISGLRSEDEADYYCAAWDDSLSGPVFGGGTKLTVL

SEQ ID NO: 307 - protein, 122 aa, Homo sapiens; identical to SEQ ID NO: 283

SEQ ID NO: 308 - protein, 107 aa, Homo sapiens
EIVLTQSPATLSLSPGERANLSCRASQSVNRYLAWYQQKPGQAPRLLIYDASNRATGVPVRFNGSGSGTDFTLTISSLEPEDFAVYYCQQRTNWPLTFGGGTKVEIK

SEQ ID NO: 309 - protein, 125 aa, Homo sapiens
QVLLQESGPGLVKASETLSLTCTVSNGSINTSSYYWNWFRQPPGKGLEWIGTIYYTGDTYYSASLKSRVTISIHRSKSQFSLKLSTVTAADTAVYYCARDPYNWNLFVADSFDVWGLGTMVTVSS

SEQ ID NO: 310 - protein, 107 aa, Homo sapiens
DIQMTQSPSTLSASVGDRVTITCRASQRISSWLAWYQQKPGKAPKLLIYKASSLESGVPSRFSGSGSGTEFTLTISSLQPDDFATYYCQQYHSYSWTFGQGTKVEIK

SEQ ID NO: 311 - protein, 116 aa, Homo sapiens
  misc_feature (103)..(103): Xaa can be any naturally occurring amino acid
EVQLVESGGGLVQPGGSLRLSCAASGFTFSSYSMNWVRQAPGKGLECVSYISSSSSTIYYADSVKGRFTISRDNAKNTLYLQMNSLGAEDTAVYYCASLYDTXILWGQGTLVTVSS

SEQ ID NO: 312 - protein, 111 aa, Homo sapiens
QSALTQPASVSGSPGQSITIPCTGTSSDVGSYNHVSWYQQHPGKAPKLIIYEVSMRPSGVSNRFSGSKSGNTASLTISGLQTEDEADYYCCSYGGDVYVWVIGGGTKLTVL

SEQ ID NO: 313 - protein, 121 aa, Homo sapiens
EVQLVESGGGLVKPGGSLRLSCAASGFTFSTYSMNWVRQAPGKGLEWVSSISGGSTYIYYADSLKGRFTISRDNAKNSLYLQMNSLSAEDTAVYYCAKPLAAAGLLALDFWGQGTQVTVSS

SEQ ID NO: 314 - protein, 110 aa, Homo sapiens
QSVLTQPASVSGSPGQSITISCTGTISDFGGYNYVSWYQHHPGKAPKLIIYEVSSRPSGVSNRFSGSKSGNTASLTISGLQAEDEADYYCNSYTSSGTRVFGGGTKLTVL

SEQ ID NO: 315 - protein, 125 aa, Homo sapiens
QVQLVQSGAEVMQVGASVRVSCKASGYTFTNHPIDWVRQAPGQGLEWMGIINPSGGGVRFAQKFQGRVTLTTDTSTSTVYMELSSLTSDDTAVYFCARGAGRDVYKSILAWFDYWGQGTLVTVSS

SEQ ID NO: 316 - protein, 107 aa, Homo sapiens; identical to SEQ ID NO: 160

SEQ ID NO: 317 - protein, 120 aa, Homo sapiens; identical to SEQ ID NO: 159

SEQ ID NO: 318 - protein, 108 aa, Homo sapiens
DIVLTQSPGTLSLSPGESATLSCRASQSVNNDYIAWYQQKPGQAPRLLIYGASSRASGIPDRFDGSGSGTDFTLTIRRLEPDDFAVYYCHQYITLPLTFGGGSKVEIR

SEQ ID NO: 319 - protein, 122 aa, Homo sapiens; identical to SEQ ID NO: 269

SEQ ID NO: 320 - protein, 108 aa, Homo sapiens; identical to SEQ ID NO: 292

SEQ ID NO: 321 - protein, 129 aa, Homo sapiens
EVQLEQSGAEVKKPGESLKISCKVSGYIFTAHWISWVRQMPGKGLEWMGRIDPNESYANYNPSFEGHVTLSTDKSTDTAYLQWSSLKASDTAIYYCVRQWDGRTTGARGWYHYYHMDFWGTGTAVTVST

SEQ ID NO: 322 - protein, 106 aa, Homo sapiens
SYELTQPSSVSVSPGQTARITCSGDVLAKKYARWFQQKPGQAPVLVIYKDSERPSGIPERFSGSSSGTTVTLTISGAQVEDEADYYCYSAADNNWVFGGGTKLTVL

SEQ ID NO: 323 - protein, 120 aa, Homo sapiens; identical to SEQ ID NO: 189

SEQ ID NO: 324 - protein, 108 aa, Homo sapiens
EIVLTQSPGTLSLSPGERATLSCRASQSVSTRHLAWYQQKPGQAPRLLIYAASRRATGIPDRFSGSGSGTDFTLTISSLEPEDFAVYYCQQYGTSPYTFGQGTKLEIK

SEQ ID NO: 325 - protein, 124 aa, Homo sapiens
EVQLVESGGGLVQPGGSLRLSCAASGFTFSSYEMNWVRQSPGKGLEWVSYISGSGGTIYYADSVKGRFTISRDNAKNSLYLQMNSLRAEDTAVYYCARDRSISWTYYYYYMDVWGKGNPGHRLL

SEQ ID NO: 326 - protein, 108 aa, Homo sapiens; identical to SEQ ID NO: 292

SEQ ID NO: 327 - protein, 124 aa, Homo sapiens
EVQLVESGGGLVKPGGSLRLSCAASGFSLRSYSMNWVRLAPGKGLERVSSISSSRSYLYYADSVKGRFTISRDNAKNSLYLQMNSLRAEDTAVYYCARDQEFNYYDSSGHFDYWGQGTLVTVSS

SEQ ID NO: 328 - protein, 108 aa, Homo sapiens
EIVMTQSPGTLSVSPGEGATLSCRASQSVGSKLAWYQQKQGQAPRLLIYGASTRATGTPARFSGSGSGTEFTLTISSLQSEDFAVYYCQQYDNWPPYTFGQGTKLQIN

SEQ ID NO: 329 - protein, 134 aa, Homo sapiens
EVQLVESGGSLVKPGGSLRLSCVGSGFTFSNYSMNWVRQAPGRGLEWVSSISSSDYIYYSDSVKGRFTISRDSAKNSVYLHMDGLRPEDTAVYFCASAPEGLNVLRAFGVVTPTNYYFLGMDVWGRGTTVTVSS

SEQ ID NO: 330 - protein, 108 aa, Homo sapiens
EIVMTQSPATLSVSPGERATLSCRASQSVSTNLAWYQQKPGQAPRLLVYGPSTRATGIPARFSGSGSGTEFTLTISSLQSEDFAIYYCKHYYNRPPYTFGQGTRVEIK

SEQ ID NO: 331 - protein, 124 aa, Homo sapiens
QVQLVQSGAEVRKPGSSTKVSCKASGGTFTSYGISWVRQAPRQGLEWLGGIIPLFDTTNYAQKFQGRVTITADRSTSTAYMELCRLRSEDTAVYYCATLSLRTPVPYDFWSKYWGQGTLVTVSS

SEQ ID NO: 332 - protein, 108 aa, Homo sapiens
EIVLTQSPGTLSLSPGERVTLSCRASQSVSSSYLAWYQQKPGQAPSLLIYDASSRATGIPDRFSGSGSGTDFTLTISRLEPEDFAVYHCQQYGTSPGTFGQGTKVEIK

SEQ ID NO: 333 - protein, 122 aa, Homo sapiens
EVQLVQSGAEVKKPGESLKISCKGSGYSFTSYWIGWVRQMPGKGLEWMGIIYPGDSDTRYRPSLQGQVTISADKSISTAYLQWSSLKASDTAIYYCARQMGRIWPHDAFDIWGRGTMVTVSS

SEQ ID NO: 334 - protein, 108 aa, Homo sapiens
EIVLTQSPGTLSLSPGERTTLSCRASQTVSNNYLAWYQQKPGQAPRLLIYGASSRATGIPDRFSGSGSGTDFTLTISRLEPEDSAVYYCQQYAGSLPTFGGGTKVEIK

SEQ ID NO: 335 - protein, 119 aa, Homo sapiens; identical to SEQ ID NO: 183

SEQ ID NO: 336 - protein, 107 aa, Homo sapiens
DIQMTQSPSTLSASVEDRVTITCRASQSINKWVAWYQQKPGKAPILLIYDASNLQTGVPSRFSGSGSGTEFSLAISSLQPDDFATYYCQQYQSYPYTFGQGTKLEIK

SEQ ID NO: 337 - protein, 122 aa, Homo sapiens
QLQLQESGPGLVKPSETLSLTCTVSGGSINSDSYYWGWIRQPPGKGLEWIGTIFYSGSTYYNPSLKSRVTLSVDTSKNQFSLKLNSVTAADTALYYCATHPPTLAARPWDHWGQGTLVTVSS

SEQ ID NO: 338 - protein, 108 aa, Homo sapiens; identical to SEQ ID NO: 334

SEQ ID NO: 339 - protein, 121 aa, Homo sapiens; identical to SEQ ID NO: 313

SEQ ID NO: 340 - protein, 108 aa, Homo sapiens; identical to SEQ ID NO: 332

SEQ ID NO: 341 - protein, 124 aa, Homo sapiens
  misc_feature (111)..(111): Xaa can be any naturally occurring amino acid
QVQLEDLGAEVRKPGSSVKVSCKASGGTFTSYGISWVRQAPGQGLEWLGGIIPLFDTTNYAQKFQGRVTITADRSTSTAYMELSRLRSEDTAVYYCATLSLRTPVPYDFWXKYWGQGTLVTVSS

SEQ ID NO: 342 - protein, 108 aa, Homo sapiens; identical to SEQ ID NO: 332

SEQ ID NO: 343 - protein, 120 aa, Homo sapiens; identical to SEQ ID NO: 189

SEQ ID NO: 344 - protein, 106 aa, Homo sapiens
DIQMTQSPSSVSASVGDRVIITCRASQYISSELVWYQQKPGKAPKVLIYAASNLQSGVPSRFSGSGSGTDFTLTIRGLQLEDCATYYCQQANTFLTFGPGTMVDIK

SEQ ID NO: 345 - protein, 119 aa, Homo sapiens; identical to SEQ ID NO: 183

SEQ ID NO: 346 - protein, 108 aa, Homo sapiens
EIVLTQSPGTLSLSPGERATLSCRASQSVSSSYLAWYQQKAGQAPRLLIYGASSRATGIPDRFSGSGSGTDFTLTISRLEPEDFAVYFCQRYDTSQGTFGQGTKLDIK

SEQ ID NO: 347 - protein, 119 aa, Homo sapiens; identical to SEQ ID NO: 167

SEQ ID NO: 348 - protein, 108 aa, Homo sapiens
KIVLTQSPGTLSLSPGERATLSCRASQSVSSSYLAWYQQKPGQAPWLLIYGAVSRATGIPDRFSGSGSGTDFTLTISRLEPEDFAVYYCQQYGSSPYTFGQGTKLEIK

SEQ ID NO: 349 - protein, 121 aa, Homo sapiens
QVQLVESGGSVVQPGRSLRLSCVAPGFTFSKSAIHWVRPAAGKVLELVAVVTYDGGAKYYADSVKGRFTISRDNSENTLYLQMNSLRPEDTAVYFCAREWNYDSSPTYDFWGQGTLVTVSS

SEQ ID NO: 350 - protein, 108 aa, Homo sapiens
EIVMTQSPGTLSVSPGEGATLSCRASQSVGSKLAWYQQKQGQAPRLLIYDASTRATGTPARFSGSGSGTEFTLTISSLQSEDFAVYYCQQYDNWPPYTFGQGTKLQIN

SEQ ID NO: 351 - protein, 122 aa, Homo sapiens; identical to SEQ ID NO: 243

SEQ ID NO: 352 - protein, 111 aa, Homo sapiens
QSALTQPASVSGSPGQSITISCTGTSSDFGGYNSVSWYQHHPGKAPKLIIYDVSNRPSGVPDRFSGSKSGNTASLTISGLQAEDEADYYCSSYTGSAPLYVFGIGTKVTVL

SEQ ID NO: 353 - protein, 126 aa, Homo sapiens
EVQLVESGGGLVKPGGSLRLSCAASGFTFSYYTVTWVRQAPGKGLEWVSSISSSSSYIIYADSVKGRFTMSRDNAKNSLYLQMNSLRAEDTAVYYCARDHYYDSSGYYYEVGMDVWGQGTTVTVSS

SEQ ID NO: 354 - protein, 108 aa, Homo sapiens
KIVLTQSPGTLSLSPGERATLSCRASQSVSSSYLAWYQQKPGQAPWLLIYGAVSRATGIPDRFSGSGSGTDFTLTISRLEPEDSAVYYCQQYGGSLPTFGGGTKVEIK

SEQ ID NO: 355 - protein, 124 aa, Homo sapiens; identical to SEQ ID NO: 341
  misc_feature (111)..(111): Xaa can be any naturally occurring amino acid

SEQ ID NO: 356 - protein, 102 aa, Homo sapiens
DIQMTQSPSTLSASVGDRVTITCRASQSFNGWLAWYQQKPGKAPKLLIYKASNLESGVPSRFSGSGSGTEFTLTISSLQPDDFATYYCQHYVFGQGTKVEVK

SEQ ID NO: 357 - protein, 124 aa, Homo sapiens
QVQLVQSGAEVRKPGSSVKVSCKASGGTFTSYGISWVRQAPGQGLEWLGGIIPLFDTTNYAQKFQGRVTITADRSTSTAYMELSRLRSEDTAVYYCATLSLRTPVPYDFWSKYWGQGTLVTVSS

SEQ ID NO: 358 - protein, 108 aa, Homo sapiens
EIVMTQSPATLSVSPGERATLSCRASQSVSSNLAWYQQKPGQAPRLLIYGASTRATGIPARFSGSGSGTEFTLTITSLQSEDFAVYYCQQYNDWPPLTFGGGTKVEIK

SEQ ID NO: 359 - protein, 119 aa, Homo sapiens; identical to SEQ ID NO: 183

SEQ ID NO: 360 - protein, 108 aa, Homo sapiens; identical to SEQ ID NO: 358

SEQ ID NO: 361 - protein, 135 aa, Homo sapiens
  misc_feature (122)..(122): Xaa can be any naturally occurring amino acid
QVQLVESGGGVVQPGRSLRLSCAASGFTFSSYAMHWVRQAPGRGLDWVAVISYDDSNKYYADSVKGRFTISRDNSKNTLYLQMNSLRAEDTAVYYCARDQGRPSYYDFWGGYHPSTNLRPVXDYWGQGTLVTVSS

SEQ ID NO: 362 - protein, 108 aa, Homo sapiens
DIQMTQSPSSLSASVGDRVTITCQASQDISNYLNWYQQKPGKAPKLLIYDATNLETGVPSRFSGSGSGTDFTFTINSLQPEDIATYYCQHYDNLPRVTFGPGTKVDIR

SEQ ID NO: 363 - protein, 122 aa, Homo sapiens
  misc_feature (109)..(109): Xaa can be any naturally occurring amino acid
EVQLLESGGGLVQPGGSLRLSCAASGFTFSNHAMSWVRQAPGKGLEGVSGISHSGRSTYFADSVKGRFTISRDNSKNTLYLQMNSLRVEDTAVYYCAKVKITIFGMVPXDYWGQGILVTVSS

SEQ ID NO: 364 - protein, 108 aa, Homo sapiens; identical to SEQ ID NO: 362

SEQ ID NO: 365 - protein, 123 aa, Homo sapiens
QVQLVAAGGGVDQPGWSLRLSCTASGFTFSTYGMHWVRQAPGKGLGWVGVISYDGRNKYADSVKGRFTISRDNSKNTLYLQADTLRPEDTAVYYCARGWAGVTVPGTHEFDYWGRGTVVTVSS

SEQ ID NO: 366 - protein, 110 aa, Homo sapiens
QAVVTQEPSLTVSPGGTVTLTCGSSTGAVTYSGHFPFWFQQKPGQAPRTLIYDTDNKHSWTPARFSGSLLGGKAALTLSGAQPDDEADYYCLLAYSDIRIFGGGTKLTVL

SEQ ID NO: 367 - protein, 124 aa, Homo sapiens; identical to SEQ ID NO: 341
  misc_feature (111)..(111): Xaa can be any naturally occurring amino acid

SEQ ID NO: 368 - protein, 108 aa, Homo sapiens; identical to SEQ ID NO: 332

SEQ ID NO: 369 - protein, 121 aa, Homo sapiens; identical to SEQ ID NO: 313

SEQ ID NO: 370 - protein, 108 aa, Homo sapiens; identical to SEQ ID NO: 358

SEQ ID NO: 371 - protein, 119 aa, Homo sapiens; identical to SEQ ID NO: 183

SEQ ID NO: 372 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK

SEQ ID NO: 373 - protein, 119 aa, Homo sapiens
EVQLVQSGAEVKKPGESLRISCQGSGYSFTTYWITWVRQMPGKGLEWMGRSDPSDSYSNYSPSFQGRVIMSFEKSTNTAYLQGTGLKASDTAIYYCARHDISGFYLPNWGQGTLVTVSS

SEQ ID NO: 374 - protein, 107 aa, Homo sapiens
AIQLTQSPSSLSASVGDRVTITCRSSLGISSALAWYQQKPGKAPKLLIYHASNLQSGVPSRFSGSGSGTDFTLTISSLQPEDFATYYCQQFSSYPITFGGGTKVEIK

SEQ ID NO: 375 - protein, 122 aa, Homo sapiens
EVQLLESGGGLVQPGGSLRLSCAASGFTFSNHAMSWVRQAPGKGLEGVSGISHSGRSTYFADSVKGRFTISRDNSKNTLYLQMNSLRVEDTAVYYCAKVKITIFGMVPYDYWGQGILVTVSS

SEQ ID NO: 376 - protein, 111 aa, Homo sapiens
QSVLTQPPSVSGAPGQRVTISCTGTSSNIGAGYDVHWYQQLPGTAPKLLDYGNSDRPTGVTDRFSGSRSGASASLAITGLQAEDEADYYCQSYDRSLSGVVFGGGTKLTVL

SEQ ID NO: 377 - protein, 122 aa, Homo sapiens
EVQLVQSGTEVKKPGESLKISCKGSGYAFFGYWIGWVRQMPGKGLEWIGLIYPDDSQSRYSPSFQGQVTMSADKSINTAYLQWGSLRASDSAMYFCARFGGPRLESTYFDYWGQGTLVTVSS

SEQ ID NO: 378 - protein, 111 aa, Homo sapiens
QSALTQPASVSGSPGQSIAISCSGTSSDVGGYDYVSWYQHHPGKAPRLMISEVSNRPSGVPDRFSGSKSGNTASLTISGLQAEDESDYYCSSYTSTSTFWVFGGGTKLTVL

SEQ ID NO: 379 - protein, 122 aa, Homo sapiens; identical to SEQ ID NO: 337

SEQ ID NO: 380 - protein, 110 aa, Homo sapiens; identical to SEQ ID NO: 366

SEQ ID NO: 381 - protein, 122 aa, Homo sapiens
EVLLVESGGGLVQPGGSLRLSCAASGFTFSEHFIDWVRQAPGKGLEWVGRSTNKANRYNTEYAASVKGRFTISRDDSKNSVYLQMNSLKTEDTAVYYCSRRKVVIHGPSDLWGQGTMVTVSS

SEQ ID NO: 382 - protein, 107 aa, Homo sapiens
EIVLSQSPGTLSFSPGERATLSCRASQSVRYNYLAWYQQKPGQAPRLLIYHTSIRATGIPDRFRGSGSGTDFILTISRLEPEDFAVYYCQHYGASSTFGPGTKVDIK

SEQ ID NO: 383 - protein, 117 aa, Homo sapiens; identical to SEQ ID NO: 197

SEQ ID NO: 384 - protein, 108 aa, Homo sapiens; identical to SEQ ID NO: 332

SEQ ID NO: 385 - protein, 119 aa, Homo sapiens; identical to SEQ ID NO: 167

SEQ ID NO: 386 - protein, 111 aa, Homo sapiens; identical to SEQ ID NO: 376

SEQ ID NO: 387 - protein, 126 aa, Homo sapiens
QVQLQESGPGLVKPSGTLSLTCAVSGGSISSTNWWSWVRQPPGKGLEWIGEIYHSGSTNYNPSLKSRVTISVDKSKNQFSLKVNSVTAADTAVYFCARVQSELDRSSRYSLYYYGMDVWGQGPIGL

SEQ ID NO: 388 - protein, 107 aa, Homo sapiens; identical to SEQ ID NO: 372

SEQ ID NO: 389 - protein, 119 aa, Homo sapiens; identical to SEQ ID NO: 183

SEQ ID NO: 390 - protein, 108 aa, Homo sapiens; identical to SEQ ID NO: 334

SEQ ID NO: 391 - protein, 123 aa, Homo sapiens
QVQLVESGGGVVQPGRSLRLSCTASGFTFSTYGMHWVRQAPGKGLEWVAVISYDGRNKYADSVKGRFTISRDNSKNTLYLQADTLRPEDTAVYYCARGWAGVTVPGTHEFDYWGRGTVVTVSS

SEQ ID NO: 392 - protein, 107 aa, Homo sapiens
DIQMTQSPSTLSASVGDRVTITCRASQSISSWLAWYQQRPGKAPKLLIYDASSLESGVPSRFSGSGYGTEFTLTISGLQPDDFATYYCQHYNNFPESFGQGTRVEIK

SEQ ID NO: 393 - protein, 122 aa, Homo sapiens
EVQLLESGGGLVQPGGSLRLSCAASGFTFSNHALSWVRQAPGKGLEGVSGISHSGRSTYFADSVKGRFTISRDNSKNTLYLQMNSLRVEDTAVYYCAKVKITIFGMVPYDYWGQGILVTVSS

SEQ ID NO: 394 - protein, 108 aa, Homo sapiens; identical to SEQ ID NO: 348

SEQ ID NO: 395 - protein, 125 aa, Homo sapiens
QITLKESGPTLVKPTQTLTLTCTFSGFSLSTTGVGVGWIRQPPEKALECLAFIYWDDDKRYSPSLESRLTITKGTSENQVVLTMTNMDPVDTATYYCAVIGEQYFGSGSWYFDYWGQGALVSVSS

SEQ ID NO: 396 - protein, 108 aa, Homo sapiens; identical to SEQ ID NO: 358

SEQ ID NO: 397 - protein, 126 aa, Homo sapiens
QVQLVQSGAEVKKPGSSVKVSCKASGGTFSSYVISWVRQAPGQGLEWMGGIIPMFDTTHYTQKFQGRLTITADESTSTAYMDLSSLRSDDTAVYYCARLIPRNYYDSSGYSSQDYWGQGTLVTVSS

SEQ ID NO: 398 - protein, 107 aa, Homo sapiens; identical to SEQ ID NO: 372

SEQ ID NO: 399 - protein, 119 aa, Homo sapiens
QVHLVESGGGVVQPGRSLRLSCAASGFSFSSYGLHWVRQAPGKGLEWVAFISYVGSNKYYADSVKGRFTISRDNSKNTLYLQMNSLRTEDTAVYYCAREYTVGGIFGFWGQGTLVTVSS

SEQ ID NO: 400 - protein, 108 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPPFTFGPGTKVDIK

SEQ ID NO: 401 - protein, 125 aa, Homo sapiens
EVQLVQSGAEGKKPGESLKISCKGSGYDFANQWIGWVRQLPGKGPEWMGIIYPGDSDTRYSPSFQGQVTISADKSITTAYLHWTSLKASDTAMYYCARHKGSDIATPTRGGFDIWGQGTMVTVSL

SEQ ID NO: 402 - protein, 107 aa, Homo sapiens
DIQMTQSPSSLSASVGDRVTITCRASQGISNYLAWYQQKPGQVPNLLIYAASTLQSGVPSRFSGSGSGTDFTLTITSLQPEDVATYYCQNYNSAPLTFGGGTKVGIK

SEQ ID NO: 403 - protein, 123 aa, Homo sapiens
QVQLVESGGGVVQPGRSLRLSCQASGFTFNRYGMHWVRQAPGKGLEWLALIWYDGSEKYYADSVKDRFTISRDNSKNMLFLQMNNLRAEDTAVYYCAKVTLTSYGDFGHEDYWGQGTLVTVSS

SEQ ID NO: 404 - protein, 110 aa, Homo sapiens
QSELTQPPSASGTPGQRITISCSGSSSNIGSNYVYWYQQFPGTTPKLLIYRNDQRPSGVPDRLSGSKSGTSASLAISGLRSEDEADYYCASWDDSVGGPRFGTGTKVTVL

SEQ ID NO: 405 - protein, 113 aa, Homo sapiens
  misc_feature (100)..(100): Xaa can be any naturally occurring amino acid
EVQLVESGGGLVQPGGSLRLSCTAPRFTLSSYSMNWVRQAPGKGLEWVSYISSSSDTMYYADSVKGRFTISRDNAKNSLFLQMNSLRAEDTAVYYCVTRXFYWGQGTLVTVSS

SEQ ID NO: 406 - protein, 109 aa, Homo sapiens
QSVLTQPPSVSAAPGQKVTISCSGSSSNIGNNYVSWYQQLPGAAPKLLIYDNNKRPSGIPDRFSGSKSGTSATLGITGLQTGDEADYYCGTWDSSLSALFGGGTKLTVL

SEQ ID NO: 407 - protein, 120 aa, Homo sapiens; identical to SEQ ID NO: 189

SEQ ID NO: 408 - protein, 108 aa, Homo sapiens
EIVLTQSPGTLSLSPGERATLSCRASQSVSSSYLAWYQQKPGQAPRLLIYGASSRATGIPDRFSGSVSRTDFTLRIHGLESGDFAVYYCQQYGSLPQTFGEGSKVEIR

SEQ ID NO: 409 - protein, 129 aa, Homo sapiens
EVQLLESGGGLVQPGGSLRLSCAASGFTFNIYAINWVRQAPGKGLEWVSSISGSGDSAYYADSVKGRFTISRDNSKNTVFLQMNSLTAEDTAVYYCAKQYCTNGVCYTDYYFYNHMDVWGKGTTVTVSS

SEQ ID NO: 410 - protein, 108 aa, Homo sapiens; identical to SEQ ID NO: 400

SEQ ID NO: 411 - protein, 112 aa, Homo sapiens
EVQLVESGGGLVQPGGSLRLSCAASGFTFSAYLMHWVRQAPGKGLVWVSRVNSDGNDRKYADSVKGRFIISRDNAKKTIYLQMNSLRAEDTAVYYCANRAGWGQGTLVTVSS

SEQ ID NO: 412 - protein, 108 aa, Homo sapiens; identical to SEQ ID NO: 400

SEQ ID NO: 413 - protein, 119 aa, Homo sapiens
QVQLEDLGAEVKKPGASVKISCKASGYIFTSYAVHWVRQAPGQRLEWMGWINAGNGETKYSQKFQGRVTITRDTSASTAYMEMSSLRSEDTAVYYCAREPPYYDFDDYWGQGTLVTVSS

SEQ ID NO: 414 - protein, 107 aa, Homo sapiens
GIQMTQSPSTLSASVGDRVTITCRASQSMNSWLAWYQQKPGKAPKLLIYEASTLESGVPSRFSGSGSGTEFTLTISSLQPDDFATYYCQQYNTYSWTFGRGTKVEIK

SEQ ID NO: 415 - protein, 122 aa, Homo sapiens
QVQLVQSGAEVKKPGSSVKVSCKASGGTFSTYAISWVRQAPGQGLEWMGRIIPILGIVNYAQKFQGRVTITADKSTSTAYMELSSLRSEDTAVYYCARGFVGATTDAEMSNWGQGTLVTVSS

SEQ ID NO: 416 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 417 - protein, 124 aa, Homo sapiens
EVQLLESGGGLVQPGGSLRLSCVVSGFTFPNSAFSWVRRAPGRGLEWVSTVSANGFSTYYADAVEGRFTISRDNAKDTLYLQMDTLRVDDTAVYYCAKTAPWVHLWFSPDWDYWGQGSLVTVSS

SEQ ID NO: 418 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIK

SEQ ID NO: 419 - protein, 121 aa, Homo sapiens
QVQLVESGGSVVQPGRSLRLSCVASGFTFSKYAMHWVRQAPGKGLEWVAVVTYDGGAKYYADSVKGRFTISRDNSENTLYLQMNSLRPEDTAVYFCAREWNYDSSPTYDFWGQGTLVTVSS

SEQ ID NO: 420 - protein, 112 aa, Homo sapiens
QSALTQPASVSGSPGQSITISCTGTSSDIGGYYYVSWYQQHPGQAPKLIIFDVSDRPSGISNRFSGSKSGNTASLTISGLQAEDEAHYFCSSYTSGSTLDVVFGGGTKLTVL

SEQ ID NO: 421 - protein, 119 aa, Homo sapiens; identical to SEQ ID NO: 167

SEQ ID NO: 422 - protein, 108 aa, Homo sapiens; identical to SEQ ID NO: 400

SEQ ID NO: 423 - protein, 123 aa, Homo sapiens
QVQLQESGAGLVKPSQTLSLTCTVSGDSISSGGYYWSWIRQYPGKDLEWIGYIYSSGSTYYNPSLKSGIIISVDTSKNQFSLKLTSVTAADTAVYYCARDPSSGSHGAAFDIWGQGTMVTVSS

SEQ ID NO: 424 - protein, 107 aa, Homo sapiens
DIQMTQSPSSLSASVGDRGTITCRASQGIGNDLGWYQQKPGKAPKRLIYAASNLNSGVPSRFSGSGSGTEFTLTISSLQPEDFATYYCLQHNTYPWTFGQGTKVEIK

SEQ ID NO: 425 - protein, 120 aa, Homo sapiens
  misc_feature (107)..(107): Xaa can be any naturally occurring amino acid
QVQLEDLGAEVKKPGSSVKVSCTASGGTFDRSVIDWVRQAPGQGLEWVGRIIPLYGSANYAQKFHGRLTISADEFTSTAYMELSSLRSEDTAVYYCAGTTLVNPKAXDYWGQGTLVTVSS

SEQ ID NO: 426 - protein, 107 aa, Homo sapiens
DIQMTQSPSTLSASVGDTVSITCRASQSFSRWLAWYQQRPGKAPKLLIYQASSLQSGVPSRFSGSGSGTEFTLTITSLQPDDFATYYCQQYNTYPYTFGQGTKVEIK

SEQ ID NO: 427 - protein, 120 aa, Homo sapiens
QVQLVQSGAEVKKPGSSVKVSCTASGGTFDRSVIDWVRQAPGQGLEWVGRIIPLYGSANYAQKFHGRLTISADEFTSTAYMELSSLRSEDTAVYYCAGTTLVNPKAFDYWGQGTLVTVSS

SEQ ID NO: 428 - protein, 108 aa, Homo sapiens
EIVLTQSPGTLSLSPGERATLSCRASQSVSGNYLAWYQQKPGQAPRLLIYGISTRATGIPDRFSGSGSGTDFTLTISRLEPEDFAVYYCQQYDTSQGTFGQGTKLEIK

SEQ ID NO: 429 - protein, 120 aa, Homo sapiens; identical to SEQ ID NO: 425
  misc_feature (107)..(107): Xaa can be any naturally occurring amino acid

SEQ ID NO: 430 - protein, 107 aa, Homo sapiens
DIQMTQSPSAMSASVGDRVTITCRASQGISNYLAWFQQKPGKVPKRLIYAASSLQSGVPSRFSGSGSGTEFTLTISSLQPEDFATYYCLQHNSYPHTFGQGTKLEIK

SEQ ID NO: 431 - protein, 122 aa, Homo sapiens; identical to SEQ ID NO: 415

SEQ ID NO: 432 - protein, 107 aa, Homo sapiens
EVVLTQSPATLSSSPGERVTLSCRASQSVSSYLAWYQQKPGQAPRLLIYDASNRATGIPASSVAVGLGQTSLSPSAAWSLKILQFITVCSVATGLRSLSAEGPRWRS

SEQ ID NO: 433 - protein, 121 aa, Homo sapiens
EVQLVESGGGWTGPGGSLRLSCAASGFIFSDHYMDWVRQAPGKGLEWVGRSWRKTESATPDYAASVRGRFTISRDDSQNSLYLQMDSLKTEDTAVYYCATSVGDTADFDYWGQGALVTVSS

SEQ ID NO: 434 - protein, 107 aa, Homo sapiens
DIQMTQSPSTLSASVGDRVTITCRASESISSWLAWYQQKPGEAPKLLMYKSSILESGVPSTFSGTGSGTEFTLTISRLQPDDFATYYCQQYNSYPHTFGQGTKLDIK

SEQ ID NO: 435 - protein, 120 aa, Homo sapiens
QVQLQESGPRLVKPSQTLSLICTVSGVSITSRGVYWNWIRHHPGKGLEWIGYVYYTGDTLYNPSLKSRLTLSVDTSKNQLSLQLSSVTAADTAVYYCARVSNFARQSDYWGHGTLVTVSS

SEQ ID NO: 436 - protein, 108 aa, Homo sapiens
EIVLTQSPGTLSLSPGERATLSCRASQSVSSSYLAWYQQKPGQAPRLLIYGASSRGTGIPDRFSGSGSGTDFTLTISRLEPEDFAVYYCHQYGTSPWTFGQGTKVEIK

SEQ ID NO: 437 - protein, 123 aa, Homo sapiens
QVQLQQWGAGLLKPSETLSLTCGVYGGSFSGYYWTWIRQSPGKGLEWIGEINHSGSTNYNPSLKSRVSISVDTSKKQFSLKLTSVTAADTAVFYCARGYGSGSYDSKSGFDIWGQGTMVTVSS

SEQ ID NO: 438 - protein, 108 aa, Homo sapiens
DIQLTQSPSFLSASVGDRVTITCRASQGISSSLAWYQQKPGKAPKLVIYAASTLQSGVPSRFSGSGSGTEFTLTISSLQSEDFATYYCQQVNDIPPYTFGQGTKLEIK

SEQ ID NO: 439 - protein, 123 aa, Homo sapiens
QVQLQESGPGLVKPSQTLSLTCTVSGDSISSGGYYWSWIRQYPGKGLEWIGYIYSSGSTYYNPSLKSGIIISVDTSKNQFSLKLTSVTAADTAVYYCARDPSSGSHGAAFDIWGQGTMVTVSS

SEQ ID NO: 440 - protein, 112 aa, Homo sapiens
DIVMTQSPLSLPVTPGEPASISCRSSQSLLHSNGNNYLDWYLQKPGQSPQLLIYLGSNRASGVPDRFSGSGSGTDFTLKISRVEAEDVGVYYCMQALQTPWTFGQGTKVEIK

SEQ ID NO: 441 - protein, 117 aa, Homo sapiens; identical to SEQ ID NO: 197

SEQ ID NO: 442 - protein, 108 aa, Homo sapiens
SYELTQPPSVSVAPGQTARITCGGDNIGSRSVHWYQQQPGQAPVLVVYDDSARRSGIPERFSGSNSGNTATLTISRVEAGDEADYYCQVWDSFSDHYVFGTGTTVTVL

SEQ ID NO: 443 - protein, 120 aa, Homo sapiens; identical to SEQ ID NO: 435

SEQ ID NO: 444 - protein, 108 aa, Homo sapiens; identical to SEQ ID NO: 442

SEQ ID NO: 445 - protein, 130 aa, Homo sapiens
QVQLMQSGAEVKKPGSSLKLSCNISGGTFSSYSVSWVRQAPGQGLEWVGGFITVSDTAHYSQKFQGRVTITADESGSTVYMDLSGLKSEDTAIYYCAGRFCRSTSCYLQLSRSLSYMDVWGTGTTVTVSS

SEQ ID NO: 446 - protein, 107 aa, Homo sapiens
DIVLTQSPATLSLSPGERTTLSCRASQSVGTYLAWYQQRPGQTPRLLIYDTSNRATGIPARFSGSGSGTDFTLTISSLEPEDVAIYYCQQRSSWPLTFGGGTKVEIE

SEQ ID NO: 447 - protein, 121 aa, Homo sapiens
EVQLVESGGGLIQPGGSLRLSCAPSGFTVSGSYMSWVRQAPGRGLEWVSVIFSGGATYYSDSVKGRFTISRDSSKNTLFLQMNNLRAEDTAIYYCARDGGFYGDYAAFDLWGLGTMVTVSS

SEQ ID NO: 448 - protein, 106 aa, Homo sapiens
EIVLTQSPATLSLSPGERATLSCRASQSVSTYLAWYQQKPGQAPRLLIYDASKRAAGIPARFSGSGSGTDFTLTISSLEPEDFAVYYCHQRSNWLTFGGGTKVEIK

SEQ ID NO: 449 - protein, 121 aa, Homo sapiens; identical to SEQ ID NO: 447

SEQ ID NO: 450 - protein, 110 aa, Homo sapiens
EIVLTQSPGTLSLSPGERATLSCRASQTISSTYLAWYQQRPGQALRLLIYGASSRATGIPDRFSGSGSGTDFTLTISRVEPEDFAVYYCQQYDYSGSLWTFGQGTKVDVK

SEQ ID NO: 451 - protein, 120 aa, Homo sapiens
EVQLVESGGGLVQPGGSLRLSCAASGFTFSTYWMSWVRQAPGKGLEWVANIKQDGSERYYVGSLKGRFTISRDNAKNSLFLQMNSLRAEDTAVYYCARDLEGKYSYFDCWGQGTLVTVSS

SEQ ID NO: 452 - protein, 108 aa, Homo sapiens
SYELTQTPSVSVAPGQTARITCGGNNIGSKSVQWYQQKPGQAPVLVVYDDTVRPSGIPERFSGSNSGSTATLTISRVEAGDEADYYCQVWDSSTDHLMFGGGTKLTVL

SEQ ID NO: 453 - protein, 117 aa, Homo sapiens
QMQLVESGGGVVQPGRSLRLSCAASGFTFSNHGIHWVRQAPGKGLEWVAVISSDGSDKYYGDSVKGRFTISRDNSQNILYLQMNSLRSEDTAVYYCAKDGGEDLDFWGQGTLVTVSS

SEQ ID NO: 454 - protein, 108 aa, Homo sapiens; identical to SEQ ID NO: 442

SEQ ID NO: 455 - protein, 122 aa, Homo sapiens
EVQLEKTGGGLVKPGGSLKLSCAASGFNLHSYTMNWVRQAPGKGLEWVSFITSDSRKTFYADSVRGRFTISRDNAKNSLFLQMNSLRAEDTAVYYCARGVEWDTSTNWFASWGQGTLVTVSS

SEQ ID NO: 456 - protein, 110 aa, Homo sapiens
QSALTQPASVSGSPGQSITISCTGTSSDVGSYNLVSWFQQHPGKAPKLMIYEGSKRPSGVSNRFSGSKSGNTASLTISGLQAEDEADYYCCSYAGSLHVVFGGGTKLTVL

SEQ ID NO: 457 - protein, 119 aa, Homo sapiens
QVQLVQSGAEVKKPGASVKISCKASGYIFTSYAVHWVRQAPGQRLEWMGWINAGNGETKYSQKFQGRVTITRDTSASTAYMEMSSLRSEDTAVYYCAREPPYYDFDDYWGQGTLVTVSS

SEQ ID NO: 458 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAIYYCQQRSTWPRTFGQGTRLEIK

SEQ ID NO: 459 - protein, 119 aa, Homo sapiens
  misc_feature (106)..(106): Xaa can be any naturally occurring amino acid
QVQLEDLGAEVKKPGASVKISCKASGYIFTSYAVHWVRQAPGQRLEWMGWINAGNGETKYSQKFQGRVTITRDTSASTAYMEMSSLRSEDTAVYYCAREPPYYDFXDYWGQGTLVTVSS

SEQ ID NO: 460 - protein, 107 aa, Homo sapiens
DIQMTQSPSSLSASVGDRVTITCRASHTIRGFLNWYQQKPGKAPNLLIYAGSSLQSGVPPRFSGSASGTDFTLTISSLQPEDFATYYCQQTYSAPRTFGQGTRVEVK

SEQ ID NO: 461 - protein, 130 aa, Homo sapiens; identical to SEQ ID NO: 445

SEQ ID NO: 462 - protein, 111 aa, Homo sapiens
QSALTQPASVSGSPGQSITISCTGTTSDIGGYNYVSWYQQHPGKAPKLMIYDVSNRPSGVSNRFSGSKSGNTASLTISGLQAEDEADYYCSSYTISRTGVLFGGGTKLTVL

SEQ ID NO: 463 - protein, 123 aa, Homo sapiens; identical to SEQ ID NO: 403

SEQ ID NO: 464 - protein, 108 aa, Homo sapiens
DLVLTQSPGTLSVFPGESATLSCRASQSLSSTYLAWYQQKPGQPPRLLIYGTSTRATGIPDRFSGSGFGTDFTLTISGLEPEDFAVYHCQHYGPSHFTFGPGTRVDLK

SEQ ID NO: 465 - protein, 123 aa, Homo sapiens
EVQLLASRGGLVQPGGSLRLSCEASGFTFSRYPMRLVRQAPGQGLGWVSGISGSGGRTYHADSVKGRFTISRDNSKNTLYLQMNSLRAEDTAVYYCAKAGTYYYDSSGYTHYWGQGTLVTVSS

SEQ ID NO: 466 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPTFGQGTKLEIK

SEQ ID NO: 467 - protein, 116 aa, Homo sapiens
QVQLVESGGGLVQPGRSLRLSCAASGFTFSSYGMHWVRQAPGKGLEWVAVIWFDGSNKFQADSVKGRFTISRDNSKNTLYLQMNSLRAEDTAVYYCARGTDDFDFWGQGTLVTVSS

SEQ ID NO: 468 - protein, 108 aa, Homo sapiens; identical to SEQ ID NO: 452

SEQ ID NO: 469 - protein, 127 aa, Homo sapiens
QVQLVESGGGLVQPGRSLRLSCAASGFPFSSYGMHWVRQAPGKGLEWVAVIVYDGKSEYYADSVKGRFTITRDNSRNTVHLQMNSLRAEDTALYYCAKDRSSWYEGLYYYYYGMDVWGQGTAVTVSS

SEQ ID NO: 470 - protein, 108 aa, Homo sapiens; identical to SEQ ID NO: 452

SEQ ID NO: 471 - protein, 116 aa, Homo sapiens
  misc_feature (103)..(103): Xaa can be any naturally occurring amino acid
QVQLVESGGGVVQPGRSLRLSCAASGFTFSSYGMHWVRQAPGKGLEWVAVIWFDGSNKFQADSVKGRFTISRDNSKNTLYLQMNSLRAEDTAVYYCARGTDDXDFWGQGTLVTVSS

SEQ ID NO: 472 - protein, 108 aa, Homo sapiens; identical to SEQ ID NO: 452

SEQ ID NO: 473 - protein, 128 aa, Homo sapiens
QVQFVQSGAEVKKPGASVKISCKASGYIFTSFGIHWVRQAPGQRLEWMGWINIGNGNTNYPQKFQGRVTISRDTSASTAYMELSSLTFEDTAVYYCARDSDPTYGYFFPKYFYAMDVWGQGTTVTVSS

SEQ ID NO: 474 - protein, 108 aa, Homo sapiens
EIVLTQSPGTLSLSPGETATLSCRASQSVSSKYLAWYQQRPGQAPRLLIYGASSRATGIPDRFSSSASRTDFTLTISGLEPEDFAVYYCQQYGSLPQTFGQGSKLEIR

SEQ ID NO: 475 - protein, 131 aa, Homo sapiens
QVRLVESGGGVVQPGRSLRLSCAASGFSFTSYSVHWVRQAPGKGLEWVAVISYDGTNKYYADSVKGRFTISRDSSKNTLYVQMSSLRAEDTAVYYCARVAYYYGSGSYYSPHFYYYGMDVWGQGTTVTVSS

SEQ ID NO: 476 - protein, 110 aa, Homo sapiens
QSALTQPRSVSGSPGQSVTISCTGTSSDVGGYNYVSWYQQHPGKAPKFMIYDVSKRPSGVPDRFSGSKSGNTASLTISGLQAEDEADYYCCSYAGSYTWVFGGGTKLTVL

SEQ ID NO: 477 - protein, 120 aa, Homo sapiens; identical to SEQ ID NO: 189

SEQ ID NO: 478 - protein, 108 aa, Homo sapiens
EIVLTQSPGTLSLSPGERATLSCRASQSVSSRYLAWYQQKPGQAPRLLIYGASSRATGIPDRFSASGSGTDFTLTISRLEPEDFAVYYCQQYGNSRFTFGPGTKVDIK

SEQ ID NO: 479 - protein, 122 aa, Homo sapiens
EVHLVESGGGLVQPGGSLRLSCAASGFTFSNYWMHWVRQTPGKGLEGVANIKQDGSEEYYVDSVRGRFTISRDNPHNSLYLQMNSLRAEDTAVYYCARVGPTGWRAGPFDSWGQGTLVTVSS

SEQ ID NO: 480 - protein, 107 aa, Homo sapiens
EVVLTQSPATLSLSPGERATLSCGASQSISNYLAWYQQKPGQSPRLLIYDASNRATGIPARFSGSGSGTDFILTISSLEPEDFAVYYCQQRSDWPPTFGGGTKVEIK

SEQ ID NO: 481 - protein, 122 aa, Homo sapiens; identical to SEQ ID NO: 243

SEQ ID NO: 482 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPLTFGGGTKVEIK

SEQ ID NO: 483 - protein, 121 aa, Homo sapiens; identical to SEQ ID NO: 313

SEQ ID NO: 484 - protein, 107 aa, Homo sapiens
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPRTFGQGTKLEIK

SEQ ID NO: 485 - protein, 122 aa, Homo sapiens; identical to SEQ ID NO: 243

SEQ ID NO: 486 - protein, 108 aa, Homo sapiens; identical to SEQ ID NO: 334

SEQ ID NO: 487 - protein, 127 aa, Homo sapiens
QVQLVQSGAEVKKPGSSVKVSCKASGGTFSSYAISWVRQAPGQGPEWMGRIIPIRAIANYAQKFQGRVTITADKSTSTAYMELSSLRSEDTAVYYCARDYCTNGVCYAGQVLSFDIWGQGTMVTVSS

SEQ ID NO: 488 - protein, 107 aa, Homo sapiens; identical to SEQ ID NO: 178

SEQ ID NO: 489 - protein, 120 aa, Homo sapiens; identical to SEQ ID NO: 189

SEQ ID NO: 490 - protein, 110 aa, Homo sapiens
QSALTQPASVSASPGQSITISCTGTSSDVGGYNYVSWYQQHPGKAPKVMIYEVSNRPSGVSNRFSGSKSGNTASLTISGLQAEDEAHYYCSSYTSDYTWVFGGGTKLTVL

SEQ ID NO: 491 - protein, 120 aa, Homo sapiens; identical to SEQ ID NO: 189

SEQ ID NO: 492 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 493 - protein, 120 aa, Homo sapiens
EVQLVDSGGGLIQPGGSLRLSCAASGFTFSNYGMSWVRQAPGKGLEWVSAISGSAGSTYYADSVKGRFIISRDNSKNTLHLQMNSLRADDTAVYYCARSVGTTHYYMDVWGKGTTVTVSS

SEQ ID NO: 494 - protein, 108 aa, Homo sapiens
DIQMTQSPSSLSASVGDRVTITCRASQSITTYLNWYQHKPGKAPKLLIYAASTLQSGVPSRFSGSGSGTDFTLTISSLQPEDFATYYCQQSFITPAWTFGQGTKLEIK

SEQ ID NO: 495 - protein, 120 aa, Homo sapiens; identical to SEQ ID NO: 493

SEQ ID NO: 496 - protein, 108 aa, Homo sapiens
SYELTQPPSVSVSPGQTARITCSGDALSKQYAYWYQKKPGQAPELVIYQDSERPSGIPERFSGSSSGTTVTLTISGVQAEDEADYYCQSTDSSGTFGVFGGGTRLTVL

SEQ ID NO: 497 - protein, 121 aa, Homo sapiens; identical to SEQ ID NO: 313

SEQ ID NO: 498 - protein, 108 aa, Homo sapiens; identical to SEQ ID NO: 264

SEQ ID NO: 499 - protein, 127 aa, Homo sapiens; identical to SEQ ID NO: 487

SEQ ID NO: 500 - protein, 106 aa, Homo sapiens
DIQMTQSPSTLSASVGDRVTITCRASQSISSWLAWYQQKPGKAPKLLIYKASSLESGVPSRFSGSGSGTEFILTISTLQPDDFATYYCQQYNSYYTFGQGTKLEIK

SEQ ID NO: 501 - protein, 122 aa, Homo sapiens; identical to SEQ ID NO: 243

SEQ ID NO: 502 - protein, 104 aa, Homo sapiens; identical to SEQ ID NO: 202

SEQ ID NO: 503 - protein, 121 aa, Homo sapiens; identical to SEQ ID NO: 419

SEQ ID NO: 504 - protein, 107 aa, Homo sapiens
DIQMTQSPSSLSASVGDRVTITCRASQGISNSLAWYQQKPGRVPKLLIHSASTLQSGVPSRFSGSGSGTDFTLTISSLQPEDVATYYCQKYNSAPFTFGPGTKVDIK

SEQ ID NO: 505 - protein, 120 aa, Homo sapiens; identical to SEQ ID NO: 189

SEQ ID NO: 506 - protein, 108 aa, Homo sapiens
ETVVTQSPATLSVPLGEGATLSCRVSQGVLTNVAWYQHRPGQAPRLLIYGASTRATGVPARFSGSGSGTEFTLAISSLESEDVAVYYCHQYSKWPPGAFGQGTKVEIK

SEQ ID NO: 507 - protein, 117 aa, Homo sapiens; identical to SEQ ID NO: 197

SEQ ID NO: 508 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 509 - protein, 117 aa, Homo sapiens; identical to SEQ ID NO: 197

SEQ ID NO: 510 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPQFTFGGGTKVEIK

SEQ ID NO: 511 - protein, 127 aa, Homo sapiens
QVQLEDLGAEVKKPGSSVKVSCKASGGTFSSYAISWVRQAPGQGPEWMGRIIPIRAIANYAQKFQGRVTITADKSTSTAYMELSSLRSEDTAVYYCARDYCTNGVCYAGQVLSFDIWGQGTMVTVSS

SEQ ID NO: 512 - protein, 113 aa, Homo sapiens
DIVMTQSPDSLAVSLGERATINCKSSQSILYSSNNKNYLAWYQQKPGQPPKLLIYWASTRESGVPDRFSGSGSGTDFTLTISSLQAEDVAVYYCQQYYSTPPTFGPGTKVDIK

SEQ ID NO: 513 - protein, 121 aa, Homo sapiens; identical to SEQ ID NO: 175

SEQ ID NO: 514 - protein, 104 aa, Homo sapiens; identical to SEQ ID NO: 202

SEQ ID NO: 515 - protein, 121 aa, Homo sapiens; identical to SEQ ID NO: 175

SEQ ID NO: 516 - protein, 108 aa, Homo sapiens; identical to SEQ ID NO: 318

SEQ ID NO: 517 - protein, 118 aa, Homo sapiens; identical to SEQ ID NO: 171

SEQ ID NO: 518 - protein, 104 aa, Homo sapiens
EIVMTQSPGTLSLSPGERATLSCRASQSVSSSYLAWYQQKPGQAPRLLIYGASSRATGIPDRFSGSGSGTDFTLTISRLEPEDFAVYYCQQYGTFDQGTKVEIK

SEQ ID NO: 519 - protein, 120 aa, Homo sapiens; identical to SEQ ID NO: 189

SEQ ID NO: 520 - protein, 106 aa, Homo sapiens
AIQMTQSPSTLSASVGDRVTITCRASQSISSWLAWYQHKPGKAPKLLIYKASTLESGVPSRFSGSGSGTEFTLTINSLQPDDFATYYCQQYNSPLTFGGGTKVEIK

SEQ ID NO: 521 - protein, 127 aa, Homo sapiens; identical to SEQ ID NO: 487

SEQ ID NO: 522 - protein, 107 aa, Homo sapiens; identical to SEQ ID NO: 492

SEQ ID NO: 523 - protein, 127 aa, Homo sapiens; identical to SEQ ID NO: 487

SEQ ID NO: 524 - protein, 114 aa, Homo sapiens
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPRYTFGQGTKLEIK

SEQ ID NO: 525 - protein, 127 aa, Homo sapiens
QVQLQESGPGLVRPSETLSLTCTLSGGFISGSSYFWGFIRQPPGKGLEWIGSIFHNGTTKFNPSLKSRVTISVEKSKNQFSLMLKSVTAADTAVYYCARHSPSMLRGVTIVGPHMDVWGKGTTVTAS

SEQ ID NO: 526 - protein, 107 aa, Homo sapiens; identical to SEQ ID NO: 162

SEQ ID NO: 527 - protein, 122 aa, Homo sapiens
QVQLVESGGGVVQPGRSLRLSCEGSGFIFSDYTMGWVRQAPGKGLEWVALISHDGSTKRSADSVEGRFSISRDNSKNLVHLHMDSLRAEDTAVYFCVRDHFLRLIREIWDNWGQGTQVTVSS

SEQ ID NO: 528 - protein, 107 aa, Homo sapiens; identical to SEQ ID NO: 162

SEQ ID NO: 529 - protein, 119 aa, Homo sapiens
QVQLVESGGGLVKPGGSLRLSCAASGFTFSDYYMTWIRQAPGKGLVWVSTISTSSSYTNSADSVKGRFTMSRDDAENSLYLQMNNLRADDTAVYYCARAYTAMAPFDLWGQGTLVTVSS

SEQ ID NO: 530 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPWTFGQGTKVEIK

SEQ ID NO: 531 - protein, 117 aa, Homo sapiens
EVQLMQSGAQIKKPGESLKISCQGSGYNFPNSWIAWVRQMPGKGLEYMGIIYASNSDTRYSPSFQGQVSISVDKSISTAYLQWSSLKASDTAMYYCARRADYAFDHWGQGTLVTVSS

SEQ ID NO: 532 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSLTFGGGTKVEIK

SEQ ID NO: 533 - protein, 122 aa, Homo sapiens; identical to SEQ ID NO: 289

SEQ ID NO: 534 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTLLITFGPGTKVDIK

SEQ ID NO: 535 - protein, 122 aa, Homo sapiens; identical to SEQ ID NO: 289

SEQ ID NO: 536 - protein, 107 aa, Homo sapiens
EIVLTQSPATLSLSPGERAALSCRASQSVVNYLAWYQQRPGQAPRLLIYDASKRASGIPPRFSGNGSGTDFTLTISSLEPEDFAVYYCQQRINWPLTFGGGTKVEIK

SEQ ID NO: 537 - protein, 122 aa, Homo sapiens
QVQLVQSGAEVMQVGASVKVSCKASAYKSTTYGIIWARQAPGQGLEFMGWVTPHNGVTKYEQKFQDKITITTDTSTGTAYMEMRSLRFDDTAIYYCARFVDSDDYRGWLDPWGRGTLVTVSS

SEQ ID NO: 538 - protein, 107 aa, Homo sapiens; identical to SEQ ID NO: 162

SEQ ID NO: 539 - protein, 125 aa, Homo sapiens
QVQLVHGLDLEDLLLASVRVSCKASGYTFTNHPIDWVRQAPGQGLEWMGIINPSGGGVRFAQKFQGRVTLTTDTSTSTVYMELSSLTSDDTAVYFCARGAGRDVYKSILAWFDYWGQGTLVTVSS

SEQ ID NO: 540 - protein, 105 aa, Homo sapiens
QAALTQPASVSGSPGQSSAISCDVAGYSYVSWFQQHPGKAPKLMIYEVSKRPSGVSNRFSGSKSGNAASLTISGLQAEDEADYYCAAFTSRNTWVFGGGTRLTVL

SEQ ID NO: 541 - protein, 127 aa, Homo sapiens; identical to SEQ ID NO: 487

SEQ ID NO: 542 - protein, 108 aa, Homo sapiens; identical to SEQ ID NO: 534

SEQ ID NO: 543 - protein, 119 aa, Homo sapiens; identical to SEQ ID NO: 169

SEQ ID NO: 544 - protein, 107 aa, Homo sapiens; identical to SEQ ID NO: 532

SEQ ID NO: 545 - protein, 119 aa, Homo sapiens
CVQLVQSGGGLIQPGGSLRLSCAASGFSFSSYWMHWVRQAPGKGLVWVSRIYRDGSGPTYADSVKGRFTIFRDSAKNTLYLQMNSLRAEDTAVYYCLRGNSGNGNFDLWGPGTLVTVSS

SEQ ID NO: 546 - protein, 105 aa, Homo sapiens; identical to SEQ ID NO: 540

SEQ ID NO: 547 - protein, 117 aa, Homo sapiens
EVQLVESGGGLVQPGGSLRLSCAASGFSFNYDWMHWVRQAPGEGPVWVSCINGDGSTIRYGESVKGRFTISRDNAKNTLYLQMNSLRLEDTAVYFCVRGTGYILSYWGPGTVVTVSS

SEQ ID NO: 548 - protein, 108 aa, Homo sapiens; identical to SEQ ID NO: 318

SEQ ID NO: 549 - protein, 122 aa, Homo sapiens; identical to SEQ ID NO: 243

SEQ ID NO: 550 - protein, 105 aa, Homo sapiens
DIQLTQSPSFLSASVGDRVTITCRASQGISNYLAWYQHRPGKAPKLLIFPASTLQSGVPSRFSGSGSGTAFTLTISSLQPEDFATYYCQQLDTYSFGGGTKVEIK

SEQ ID NO: 551 - protein, 120 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCAEGSGSSSLQSYYWGQGTLVTVSS

SEQ ID NO: 552 - protein, 108 aa, Homo sapiens; identical to SEQ ID NO: 318

SEQ ID NO: 553 - protein, 119 aa, Homo sapiens; identical to SEQ ID NO: 305

SEQ ID NO: 554 - protein, 105 aa, Homo sapiens; identical to SEQ ID NO: 550

SEQ ID NO: 555 - protein, 131 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARKPSIAVAVRWGRSKINNWFDPWGQGTLVTVSS

SEQ ID NO: 556 - protein, 107 aa, Homo sapiens; identical to SEQ ID NO: 504

SEQ ID NO: 557 - protein, 117 aa, Homo sapiens; identical to SEQ ID NO: 225

SEQ ID NO: 558 - protein, 105 aa, Homo sapiens
QAVLTQPASVSGSPGQSSAISCDVAGYSYVSWFQQHPGKAPKLMIYEVSKRPSGVSNRFSGSKSGNAASLTISGLQAEDEADYYCAAFTSRNTWVFGGGTRLTVL

SEQ ID NO: 559 - protein, 122 aa, Homo sapiens; identical to SEQ ID NO: 289

SEQ ID NO: 560 - protein, 106 aa, Homo sapiens; identical to SEQ ID NO: 520

SEQ ID NO: 561 - protein, 123 aa, Homo sapiens
EVQLVQSGAEVKKSGESLKISCKGSGYSFSSYWIAWVRHMPGKGLEWMGIIYPGNSETKYSPSFQGQITMSVDKSISIAYLQWSSLKASDTAIYYCARRGYSISWGRVWMDVWGQGTTVTVSS

SEQ ID NO: 562 - protein, 109 aa, Homo sapiens
SYELTQPPSVSVAPGKTARITCGGNNIGSKSVHWYQQKPGQAPVLVIYDDSDRPSGIPERFSGSNSGNTATLTISRVEAGDEADYYCQVWDSSSDHHAVFGGGTQLTVL

SEQ ID NO: 563 - protein, 127 aa, Homo sapiens
QVQLVQSGAEVKKPGSSVTVSCKASGGTFSSYGLSWVRQAPGQGPEWMGGIIPILGKPTYAPKFQGRVTITADESTSTAYLELSSLRSEDTATYYCARGGDYTGSYYDYYYYYMDAWGKGTTVTVSS

SEQ ID NO: 564 - protein, 109 aa, Homo sapiens
EIVLTQSPDTLSLSPGERATLSCRASQSVSNNRRLAWYQRKPGQAPRLLIYGASVRATGIPDRFSGSESGTDFTLTISRLEPEDFGVYYCQQYGNSPPTFGQGTKVELK

SEQ ID NO: 565 - protein, 125 aa, Homo sapiens
QVQLVESGGGVVQPGRSLRLSCAASGFTFRSYTMHWVRQAPGKGLEWVAVISYDGSYKYYADSVKGRFTISRDNSKNTLYLQMNSLRAEDTAVYYCARDVIEYSGSSEYYGMDVWGQGTTVTVSS

SEQ ID NO: 566 - protein, 106 aa, Homo sapiens
DIQMTQSPSSLSASVGDRVTITCRASRSISNYLNWYQQKPGKVPKLLIYTASSLQSGVPSRFSGGGSGTDFTLTISNLQPEDFATYYCQQSYSTLTFGGGTKVEIK

SEQ ID NO: 567 - protein, 130 aa, Homo sapiens
QVQLQQKGAALLKPSETLSLTCGVSGGTFSDYHWTWVRQPPGKGLEWIGKINHGGSTNYNPTLKSRVSISIDTSKSQFSLKMTSLTAADAAVYFCARLREGRALRLTPQPRYSYYHMDVWGKGTTVTVSS

SEQ ID NO: 568 - protein, 106 aa, Homo sapiens; identical to SEQ ID NO: 566

SEQ ID NO: 569 - protein, 131 aa, Homo sapiens
EVQLLESGGGLGQPGGSLRLSCAASGFTFSDYAMSWVRQAPGKGLEWVSTIDTSGRRTYYADSVKSRFAISRDNSKDTLYLQVNTLRAEDTAIYYCAKDLAEEESLGFCDGNNCPDAFDIWGQRTRVTVSS

SEQ ID NO: 570 - protein, 109 aa, Homo sapiens; identical to SEQ ID NO: 564

SEQ ID NO: 571 - protein, 120 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVLRLGELSFRNWGQGTLVTVSS

SEQ ID NO: 572 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKLEIK

SEQ ID NO: 573 - protein, 119 aa, Homo sapiens
EVQLVESGGGLVQPGGSLKLSCAASGFTFSGSAIHWVRQASGKGLEWVGRIRSKANSYATAYAASVKDRFTISRDDSKNTAYLQMNSLKSEDTAVYYCTRHNVDTALEWGQGTLVTVSS

SEQ ID NO: 574 - protein, 111 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGGGTKLTVL

SEQ ID NO: 575 - protein, 123 aa, Homo sapiens
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVLRVRYSLFYYFDYWGQGTLVTVSS

SEQ ID NO: 576 - protein, 109 aa, Homo sapiens; identical to SEQ ID NO: 562

SEQ ID NO: 577 - protein, 127 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARPQSQLDRSGSSYFVAFDIWGQGTMVTVSS

SEQ ID NO: 578 - protein, 110 aa, Homo sapiens
QSVLTQPRSVSGSPGQSVTISCSGTSSDVGGFDYVSWYQQHPGKAPKLIIYGVTERPSGVPDRFSGSKSANTASLTISGLQADDEAAYYCCSYAGTYILLFGGGTKLTVL

SEQ ID NO: 579 - protein, 120 aa, Homo sapiens
QLQLQESGPGLVKSSEPLFLTCTVSGASISSSNYYWGWIRQPPGKGLEWIGSIYYSETTYYNPSLESRVTISVDTSKHQFSLIVTSMTAADTAVYYCAGLRRGGNWFDPWGQGNPSHRLL

SEQ ID NO: 580 - protein, 108 aa, Homo sapiens
GIVMTQSPATLSVSPGERATLSCRASQSVSSSYLAWYQQKPGQPPRLLIYGASTRATGIPARFSGSGSGTEFTLTISSLQSEDFAVYYCQQYSNWPLTFGGGTKVEIK

SEQ ID NO: 581 - protein, 120 aa, Homo sapiens; identical to SEQ ID NO: 571

SEQ ID NO: 582 - protein, 109 aa, Homo sapiens
QSALTQPPSASGSPGQSVTISCTGTSRDVGGYDFVSWYQQHPGKAPKLMIYEVTKRPSGVPDRFSGSKSGNRASLTVSGLQAEDEADYYCSSYAGNNILFGGGTKLTVL

SEQ ID NO: 583 - protein, 122 aa, Homo sapiens
QVQLVESGGGVVQPGRSLRLSCAASGFTLRNYAMHWVRQAPGKGLEWVAVLSYDGNNKKYADSVKGRFTISRDISNNTLYLHMDSLRAEDRAVYYCARDRTPYSSGWYVGYWGQGTLVTVSS

SEQ ID NO: 584 - protein, 109 aa, Homo sapiens; identical to SEQ ID NO: 582

SEQ ID NO: 585 - protein, 120 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVLRLGEVSFRNWGQGTLVTVSS

SEQ ID NO: 586 - protein, 109 aa, Homo sapiens; identical to SEQ ID NO: 572

SEQ ID NO: 587 - protein, 125 aa, Homo sapiens; identical to SEQ ID NO: 565

SEQ ID NO: 588 - protein, 108 aa, Homo sapiens
DIQMTQSPSSLSASVGDRVTITCRASQGISNYLAWYQQKPGKVPKLLIYAASTLQSGVPSRFSGSGSGTDFTLTISSLQPEDVATYYCQKYNSAPPWTFGQGTKVEIK

SEQ ID NO: 589 - protein, 123 aa, Homo sapiens
EVQLVESGGDLVQPGGSLRLSCAASGFTFTTYWMSWVRQTPGKGLEWLANIKQDGSEKYYVDSVKGRFTISRDNAKNSVYLQMSSLRDEDTAVYYCARQGVVISSATNWFDPWGQGTLVTVSS

SEQ ID NO: 590 - protein, 110 aa, Homo sapiens
QSALTQPASVSGSPGQSITISCAGTRNDVGAYNYVSWHQQHPGQTPKLLIYDVDDRPSGVSNRFSGSKSGNTASLTISRLQAEDEADYYCSSYTTSGTYVFGTGTKVTVV

SEQ ID NO: 591 - protein, 127 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQSIAARPSWSDYYYMDVWGKGTTVTVSS

SEQ ID NO: 592 - protein, 108 aa, Homo sapiens
SYELTQPPSVSVAPGKTARITCGGDNIGSKSVHWYQQKPGQAPVLVIYYDSDRPSGIPERFSGSNSGNTATLTISRVEAGDEADFYCQVWDGSSDHVVFGGGTKLTVL

SEQ ID NO: 593 - protein, 122 aa, Homo sapiens
QVQLQQSGPGLVKPSQTLSLTCAISGDSVSSESVAWNWIRQSPSRGLEWLGRTYYRSRWYSDYAVSVKSRITINPDTSKNQFSLQVSSMTPEDTAVYYCARVFSSSGHFDYWGQGTLVTVSS

SEQ ID NO: 594 - protein, 109 aa, Homo sapiens; identical to SEQ ID NO: 564

SEQ ID NO: 595 - protein, 126 aa, Homo sapiens
EVQLVESGGGLVQPGGSLRLSCAASGFTFSHYWMAWVRQAPGKGLEWVANIKEDGSTKQYVGSVKGRFTISRDNGKNLVYLQMNSLRAEDTAVYYCAKESGFWSGHYSSDDKFQHWGQGTWVTVSS

SEQ ID NO: 596 - protein, 107 aa, Homo sapiens
EIVLTQSPATLSLSPGERATLSCRASQSVSSYLGWYQHKPGQAPRLLIYDTSNRATGIPARFSGSGSGTDFILTISSLEPEDFAVYYCQQRSNWPLTFGGGTKVEIK

SEQ ID NO: 597 - protein, 127 aa, Homo sapiens
QVQLVQSGAEVKKPGSSVTVSCKASGGTFSSYGLSWVRQAPGQGPEWMGGIIPILGKPTYAPKFQGRVTITADESTSTAYLELSSLRSEDTATYYCARGGDYTGSYYDYYYYYMDVWGKGTTVTVSS

SEQ ID NO: 598 - protein, 111 aa, Homo sapiens; identical to SEQ ID NO: 574

SEQ ID NO: 599 - protein, 120 aa, Homo sapiens; identical to SEQ ID NO: 571

SEQ ID NO: 600 - protein, 108 aa, Homo sapiens; identical to SEQ ID NO: 580

SEQ ID NO: 601 - protein, 120 aa, Homo sapiens; identical to SEQ ID NO: 571

SEQ ID NO: 602 - protein, 110 aa, Homo sapiens; identical to SEQ ID NO: 578

SEQ ID NO: 603 - protein, 128 aa, Homo sapiens
EEQLVESGGGLVQPGGSLRLSCAASGFNFSSFWMHWVRQAPGKGLVWVSRIDSAGATTTYADSVKGRFTISRDNANNTLYLQMSSLRAEDTAVYYCARLSSAPWSGFYVWHANWFDPWGQGTLVTVSS

SEQ ID NO: 604 - protein, 111 aa, Homo sapiens; identical to SEQ ID NO: 574

SEQ ID NO: 605 - protein, 125 aa, Homo sapiens
EVHLVESGGGLVKPGESLRLSCEASGFTFTNAWMSWVRQAPGKGLEWIGRIKGESEGGTADYAAPVKGRFSMSRDNSKNIVYLQMNSLKTEDTATYYCVTELGTALWVIDYFDNWGQGTLVTVSS

SEQ ID NO: 606 - protein, 109 aa, Homo sapiens
QSVLTQPPSASGSPGQSVTISCTGTSRDVGGYDFVSWYQQHPGKAPKLMIYEVTKRPSGVPDRFSGSKSGNRASLTVSGLQAEDEADYYCSSYAGNNILFGGGTKLTVL

SEQ ID NO: 607 - protein, 124 aa, Homo sapiens
EVQLLESGGGVVQPGGSVRLSCAASGFTFISYAMSWVRQAPGKGLEWVSAVSVSGGTTYYADSVKGRFTISRDNSKKTLYLQMNSLRAEDTAVYYCAKEGVEMTRSFGYYFDHWGRGTLVTVSS

SEQ ID NO: 608 - protein, 107 aa, Homo sapiens; identical to SEQ ID NO: 596

SEQ ID NO: 609 - protein, 128 aa, Homo sapiens; identical to SEQ ID NO: 603

SEQ ID NO: 610 - protein, 108 aa, Homo sapiens; identical to SEQ ID NO: 592

SEQ ID NO: 611 - protein, 127 aa, Homo sapiens
EVQLVESGGALVQPGGSLRLSCAASGSIVNNNYMNWVRQAPGKGLEWVSVIYKGGNTYYADSVKGRFTISRDNSKNMVYLQMNRLRAEDTAVYYCARALLGGTPNGPTNAWYWFHPWGLGTLVTVSS

SEQ ID NO: 612 - protein, 106 aa, Homo sapiens
DTQMTQSPSTLSASVGDRVTITCRASQSISTWLAWYQQKPGKAPKLLIYKASSVESGVPSRFSGSGSGTEFTLTISSLQPDDLGTYYCQQYSTYSTFGQGTKVDIK

SEQ ID NO: 613 - protein, 126 aa, Homo sapiens
QVQLQQSGPGLVKPSQTLSLTCTISGDTVSSNSASWNWIRQSPSRGLEWLGRTKYRSKWYYDYAVSVKSRISINPDTSKNQFSLQLNSVTPEDTAVYYCARGLDIPPDGIVGFDFWGQGTLVTVSS

SEQ ID NO: 614 - protein, 106 aa, Homo sapiens; identical to SEQ ID NO: 612

SEQ ID NO: 615 - protein, 120 aa, Homo sapiens
QLQLQESGPGLVKSSEPLFLTCTVSGASISSSNYYWGWIRQPPGKGLEWIGSIYYSETTYYNPSLESRVTISVDTSKHQFSLIVTSMTAADTAVYYCAGLRRGGNWFDPWGQGTLVTVSS

SEQ ID NO: 616 - protein, 107 aa, Homo sapiens
DIQMTQSPSTLSASVGDRVSITCRASQSISTWLAWYQQKPGKAPKLLIYKASSLQSGVPSRFSGSGSGTVFTLTISSLQPDDFATYYCQQYNSYSRTFGQGTKVEIK

SEQ ID NO: 617 - protein, 127 aa, Homo sapiens
QLQLVESGGGVVQTGRSLRLSCLASGFTLSGFAMHWVRQTPHKGLEWVAVISSDGGDIYYADSVKGRFTISRDNFKNTIFLQMNNLRGDDTAVYFCVRPQSQLDRSGSSYFVAFDIWGQGTMVTVSS

SEQ ID NO: 618 - protein, 108 aa, Homo sapiens
DIQMTQSPSSLSASVGDRVSLTCRSSQTIYNYLNWYQQQPGKAPKLLIYAASTLHRGVPSRFSGSGSGTHFTLSISSLQHEDFATYYCQQNYLTPPWTFGPGTRVEVN

SEQ ID NO: 619 - protein, 121 aa, Homo sapiens; identical to SEQ ID NO: 433

SEQ ID NO: 620 - protein, 111 aa, Homo sapiens
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGGGTKLTVL

SEQ ID NO: 621 - protein, 132 aa, Homo sapiens
QIQLQESGPGLVKPSQTLSLTCTVSGGSLSSGDYYWSWIRQPPGKGLEWIGYIYYSGSTSHNPSLKSRVSISVDTSKNQFSLKLSSVSAADTAVYYCARYYYATSGFYERPPGPRFNWFDPWGQGTLVTVSS

SEQ ID NO: 622 - protein, 108 aa, Homo sapiens; identical to SEQ ID NO: 592

SEQ ID NO: 623 - protein, 128 aa, Homo sapiens
EVQLVESGGDLVQPGGSLRLSCAASGFTFSNYWMHWVRPAPGKGLVVVARISGDGSDADYADSVRGRFTISRDNAKNTLFLQMNSLRVEDTAVYYCVRDRDVRDCNNGVCHTAYFNYWGQGTLVTVSS

SEQ ID NO: 624 - protein, 110 aa, Homo sapiens
QSALTQPPSASGSPGQSVTISCTGSRSDIGGYNYVSWYQHHPGKGPKLMIYEVSRRPSGVPDRFSGSKSGNTASLTVSGLQADDEANYYCSSYGGSTNVIFGGGTKLTVL

SEQ ID NO: 625 - protein, 123 aa, Homo sapiens
QVQLVESGGGLVKPGGSLRLPCAASGFTFSDYYMSWIRQAPGKGLEWFSYISSSGSTIYYADSVKGRFTISRDNAKNSLYLQMNSLRAEDTAVYYCARVLRVRYSLFYYFDYWGQGTLVTVSS

SEQ ID NO: 626 - protein, 109 aa, Homo sapiens; identical to SEQ ID NO: 582

SEQ ID NO: 627 - protein, 118 aa, Homo sapiens
QLQLQESGPGLVKPSETLSLTCTVSGGSIRSSSYYWGWIRQPPGKGLEWIGSIYYSGSTYYNPSLKSRVTISVDTSKNQFSLKLSSVTAADTAVYYCAYYDFWSGLVWGKGTTVTVSS

SEQ ID NO: 628 - protein, 108 aa, Homo sapiens; identical to SEQ ID NO: 588

SEQ ID NO: 629 - protein, 121 aa, Homo sapiens
EVQLVESGGGLVQPGGSLRLSCAASGFIFSDHYMVWVRQSPGKGREWVGRSWRKTESATPDYAASVRGRFTISRDDSQNSLYLQMDSLKTEDTAVYYCATSVGDTADFDYWGQGALVTVSS

SEQ ID NO: 630 - protein, 108 aa, Homo sapiens; identical to SEQ ID NO: 592

SEQ ID NO: 631 - protein, 132 aa, Homo sapiens; identical to SEQ ID NO: 621

SEQ ID NO: 632 - protein, 110 aa, Homo sapiens
QSVVTQPPSASGTPGQSVTISCSGSTSNIASSDVYWYQHLPGAAPNLLIYKNNQRPSGVPDRFSGSKSGTSASLAISGLRAEDEANYYCATWDDSLRGPIFGGGTKLSVI

SEQ ID NO: 633 - protein, 122 aa, Homo sapiens; identical to SEQ ID NO: 593

SEQ ID NO: 634 - protein, 110 aa, Homo sapiens
QSVLTQPPSASGSPGQSVTISCTGSRSDIGGYNYVSWYQHHPGKGPKLMIYEVSRRPSGVPDRFSGSKSGNTASLTVSGLQADDEANYYCSSYGGSTNVIFGGGTKLTVL

SEQ ID NO: 635 - protein, 126 aa, Homo sapiens
EVQLVESGGGLVQPGGSLRLSCAASGFTFSDHYMDWVRQAPGKGLEWVGRTRNRAKSYTTEYAASVKGRFTISRDDSKNSLYLQMNSLKTEDTAVYYCARARPLGGSGTNYGMDVWGQGTTVTVSS

SEQ ID NO: 636 - protein, 111 aa, Homo sapiens; identical to SEQ ID NO: 574

SEQ ID NO: 637 - protein, 128 aa, Homo sapiens; identical to SEQ ID NO: 623

SEQ ID NO: 638 - protein, 108 aa, Homo sapiens; identical to SEQ ID NO: 592

SEQ ID NO: 639 - protein, 127 aa, Homo sapiens; identical to SEQ ID NO: 617

SEQ ID NO: 640 - protein, 106 aa, Homo sapiens; identical to SEQ ID NO: 612

SEQ ID NO: 641 - protein, 132 aa, Homo sapiens; identical to SEQ ID NO: 621

SEQ ID NO: 642 - protein, 111 aa, Homo sapiens; identical to SEQ ID NO: 574

SEQ ID NO: 643 - protein, 127 aa, Homo sapiens; identical to SEQ ID NO: 617

SEQ ID NO: 644 - protein, 109 aa, Homo sapiens; identical to SEQ ID NO: 582

SEQ ID NO: 645 - protein, 127 aa, Homo sapiens; identical to SEQ ID NO: 617

SEQ ID NO: 646 - protein, 111 aa, Homo sapiens; identical to SEQ ID NO: 574

SEQ ID NO: 647 - protein, 123 aa, Homo sapiens
QVQLVQSGAEVMQVGASVKVSCKTSGYTFTSYYLHWMRQAPGQGLEWMGIINPSGGSTSYAQKFQGRVTMTRDTSTSTVYMELSSLRSEDTAVYYCARGALTMVRAVEYFQHWGQGTLVTVSS

SEQ ID NO: 648 - protein, 111 aa, Homo sapiens; identical to SEQ ID NO: 574

SEQ ID NO: 649 - protein, 127 aa, Homo sapiens; identical to SEQ ID NO: 617

SEQ ID NO: 650 - protein, 110 aa, Homo sapiens
QSALTQPASVSGSPGQSITISCTGTSSDVGGYNYVSWYQQHPGKAPKLIIYDVSNRPSGVSDRFSGSKSDNTASLTISGLQAEDEADYYCNSYTSTSTLVFGGGTKLTVL

SEQ ID NO: 651 - protein, 121 aa, Homo sapiens
EEKLLESGGGLVKPGGSLRLSCTASGFVFKNYVMSWVRRAPGRGLEWISGIRGGDQMTFYANSVKGRFIISRDNVKNMVHLQMNDLRDDDTAIYYCTKVVVESLENWFDAWGQGTLVTVTS

SEQ ID NO: 652 - protein, 111 aa, Homo sapiens
QSVLTQPPSVSGALGQRVTISCTGTSSNIGARYDVYWYQQFSGRAPKLLIYGNMNRASGVPDRFSGSKSGTSASLAITGVQPEDEADYFCQSFDTRLNMVLFGGGTKLTVL

SEQ ID NO: 653 - protein, 120 aa, Homo sapiens
QVQLVQSGAEVMQVGASVKLSCEASGYKFTSYTMHWVRQAPGQRVEWMGWISVGNGNTKYSQKFQGRVTITRDTSANTAYMEVRSLRSEDTAVYYCAREGYGSGTYFDYWGQGTLVTVSS

SEQ ID NO: 654 - protein, 110 aa, Homo sapiens; identical to SEQ ID NO: 650

SEQ ID NO: 655 - protein, 121 aa, Homo sapiens; identical to SEQ ID NO: 651

SEQ ID NO: 656 - protein, 107 aa, Homo sapiens; identical to SEQ ID NO: 596

SEQ ID NO: 657 - protein, 127 aa, Homo sapiens
QLQLHESGPRLLKPSETLSLTCTVSGGSISNSNFCWGWIRQPPGKGLEWIGSVFYGGTTYYNPSLKSRVALSLDASENQFSLKVTSVTAADTAMYYCARTRGRLYDYVGWYYYMDVWGRGTTVTVSS

SEQ ID NO: 658 - protein, 107 aa, Homo sapiens
KIVLTQSPATLSLSPGERATLSCRASQSVSSYLGWYQHKPGQVPRLLIYDTSNRATGIPARFSGSGSGTDFILTISSLEPEDFAVYYCQQRSNWPLTFGGGTKVEIK

SEQ ID NO: 659 - protein, 121 aa, Homo sapiens
EVQLVESGGGLVQPGGSLRLSCAASGFIFSDHYMDWVRQAPGKGLEWVGRSWRKTESATPDYAASVRGRFTISRDDSQNSLYLQMDSLKTEDTAVYYCATSVGDTADFDYWGQGALVTVSS

SEQ ID NO: 660 - protein, 111 aa, Homo sapiens
QSVLTQPRSASGTPGQRVTISCSGSRSNIGRNTVNWYQQLPGTAPKLLIFGNDQRPSGVPDRFSGSKSGTSASLAISGLQSEDEADYYCAAWDDTLNGLYVFGTGTKVTVL

SEQ ID NO: 661 - protein, 121 aa, Homo sapiens
EVQLVESGGGLVQPGGSLRLSCAASGFIFSDHYMDWVRQAPGKGLEWVGRSWRKTESATPDYAASVRGRFTISRDDSQNSLYLQMDSLKTEDTAVYYCATSVGDTTDFDYWGQGALVTVSS

SEQ ID NO: 662 - protein, 108 aa, Homo sapiens
KIVLTQSPGTLSVSPGERVTLSCRTSQSVSNNYLAWYQHKPGQAPRLLIYGASSGASDIPDRFSGGGSGTDFTLTISRLEPEDFAVYYCQQYGTSPWTFGQGTKVEIK

SEQ ID NO: 663 - protein, 126 aa, Homo sapiens
EVQLVQSGAEVKKPGESLRISCKASGYSFANYWINWVRQMPGEGLEWLGRIDPSDSYTNYSPSFQGHVTISTDTSISTVYLQWRSLKASDTAMYYCARPAAEVVPDSLVEDPFNVWGQGTMVTVSS

SEQ ID NO: 664 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 665 - protein, 134 aa, Homo sapiens
QVQLQQSGPGLVKPSQTLSLTCAISGDSVSSNSAAWNWIRQSPSRGLEWLGRTYYRSKWYHDYALSVKSRITINPDTSKNQFSLQLNSVTPEDTAVYYCARAAWEGGGYQLVLYYSYYYGMDVWGQGTTVTVSS

SEQ ID NO: 666 - protein, 111 aa, Homo sapiens; identical to SEQ ID NO: 652

SEQ ID NO: 667 - protein, 121 aa, Homo sapiens; identical to SEQ ID NO: 651

SEQ ID NO: 668 - protein, 109 aa, Homo sapiens; identical to SEQ ID NO: 572

SEQ ID NO: 669 - protein, 121 aa, Homo sapiens
EVQLVESGGGLVQPGGSLRLSCVASGFPFDNSAMHWVRQAPGKGLEWVSGINWNSVTMDYGDSVKGRFTISRDYAKNSVYLQMNNLRIEDTALYYCAKADCSSTSCFMDVWGRGTTVTVSS

SEQ ID NO: 670 - protein, 107 aa, Homo sapiens; identical to SEQ ID NO: 596

SEQ ID NO: 671 - protein, 124 aa, Homo sapiens
QVQLVQSGAAVKKPGAAVKVSCKPSGYTFASHDINWVRQATGQGLEWMGWMNPKSGNTGYAQKFRGRLTMTRNASTTTAYMEMTGLTSEDSAVYYCARGRVGKPQDYYYHLDVWGKGTTVTVSS

SEQ ID NO: 672 - protein, 112 aa, Homo sapiens
QSVLTQPPSVSGAPGQKVTISCTGGSSNIGADYDVHWYQHLPETAPKLLIYGNSNRPSGVPDRFSGSKSGTSASLAITGLQAEDEADYYCQSYDSSLGGSYVFGTGTKVTVL

SEQ ID NO: 673 - protein, 126 aa, Homo sapiens
QVQLVESGGGLVKPGGSLRLSCAASGFIFSDYYMSWIRQAPGKGLEWVSYISGSGGTIHYADSVRGRFTISRDNAKNSLYLQVNSLRAEDTAVYYCARELVPVAMRHYYFYGMDVWGQGTTVTVSS

SEQ ID NO: 674 - protein, 112 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDRSLSGPVVFGGGTKLTVL

SEQ ID NO: 675 - protein, 121 aa, Homo sapiens; identical to SEQ ID NO: 651

SEQ ID NO: 676 - protein, 109 aa, Homo sapiens
QSALTQPRSVSGSPGQSVTISCTGTSSDVGSNNYVSWYQQHPGKAPKLMIYDVSKRPSGVPDRFSGSKSDNTASLTISGLQAEDEADYYCCSYTGSRVVFGGGTKLTAL

SEQ ID NO: 677 - protein, 128 aa, Homo sapiens; identical to SEQ ID NO: 623

SEQ ID NO: 678 - protein, 111 aa, Homo sapiens; identical to SEQ ID NO: 652

SEQ ID NO: 679 - protein, 132 aa, Homo sapiens; identical to SEQ ID NO: 621

SEQ ID NO: 680 - protein, 111 aa, Homo sapiens; identical to SEQ ID NO: 652

SEQ ID NO: 681 - protein, 121 aa, Homo sapiens; identical to SEQ ID NO: 659

SEQ ID NO: 682 - protein, 107 aa, Homo sapiens
DIQMTQSPSSVSASIGDRVTITCRASQGINRWLPWYQQKPGKAPRLLIYAASSLQSGVPSRFSGSGSGTDFTLTISSLQPEDFCNLLLSTGSDFPPHFRRRDQGGDQ

SEQ ID NO: 683 - protein, 121 aa, Homo sapiens; identical to SEQ ID NO: 669

SEQ ID NO: 684 - protein, 111 aa, Homo sapiens; identical to SEQ ID NO: 652

SEQ ID NO: 685 - protein, 121 aa, Homo sapiens; identical to SEQ ID NO: 659

SEQ ID NO: 686 - protein, 107 aa, Homo sapiens
EIVMTQSPATLSVSPGEKATLSCKASQSLSSDLAWYQQKRGQAPRLLIYGASTRASGIPARFSGSGSGTEFTLTITSLQSEDFQVYYCQQYNNWPPTFGLGTKVEIN

SEQ ID NO: 687 - protein, 121 aa, Homo sapiens; identical to SEQ ID NO: 669

SEQ ID NO: 688 - protein, 110 aa, Homo sapiens; identical to SEQ ID NO: 650

SEQ ID NO: 689 - protein, 121 aa, Homo sapiens; identical to SEQ ID NO: 659

SEQ ID NO: 690 - protein, 110 aa, Homo sapiens; identical to SEQ ID NO: 650

SEQ ID NO: 691 - protein, 127 aa, Homo sapiens; identical to SEQ ID NO: 617

SEQ ID NO: 692 - protein, 113 aa, Homo sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQTIQLPPYTFGQGTKLEIK

SEQ ID NO: 693 - protein, 121 aa, Homo sapiens
EVQLLESGGGLVQPGGSLRLSCAASGFRFSSYAMSWVRQAPGKGLEWVSAISGSGGNTYYADSVKGRFTISRDNSKNTLYLQMSSLRVGDTAIYYCAKRDSAPYPDSFDYWGQGTLVTVSS

SEQ ID NO: 694 - protein, 103 aa, Homo sapiens
EIVLTQSPATLSVSPGERATLSCRASQSVSSNLAWYQQKPGQAPRLLIYGASTRATGIPARFSGSESGTELTLTISSLQSEDFAVYYCQYRGTFGQGTKLEIK

SEQ ID NO: 695 - protein, 123 aa, Homo sapiens
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVLRVRYSLFYYFDYWGQGTLVTVTS

SEQ ID NO: 696 - protein, 110 aa, Homo sapiens
QSALTQPASVSGSPGQSITISCTGTSSDIGGYDYVSWYQQHPDTAPKLIIYDVYNRPSGVPDRFTASKSDNTASLTISGLQAEDEADYFCSSYANVNTILFGGGTKVTVL

SEQ ID NO: 697 - protein, 121 aa, Homo sapiens; identical to SEQ ID NO: 659

SEQ ID NO: 698 - protein, 109 aa, Homo sapiens
EIVLTQSPGTLSLSPGERATLSCRASQSVSSSYLAWYQQKPGQAPRFLIYGASSRATGIPDRFSGSGSGTDFTLTISRLEPEDFAVYYCQQYGSSPPYTFGQGTKLEIK

SEQ ID NO: 699 - protein, 119 aa, Homo sapiens; identical to SEQ ID NO: 399

SEQ ID NO: 700 - protein, 107 aa, Homo sapiens
EVVLTQSPATLSVSPGERATLSCRASQSVSSNLAWYQQKPGQAPRLLIYGASTRATGFPARFSGSGSGTEFTLTISSLQSEDFAIYHCQQYNNWPLTFGGGTKVEIK

SEQ ID NO: 701 - protein, 124 aa, Homo sapiens; identical to SEQ ID NO: 671

SEQ ID NO: 702 - protein, 108 aa, Homo sapiens
EIVMTQSPATLSVSPGERVTLSCRASQSVGSNLAWYQQKPGQAPRLLIYGASSRAAGIPDRFRGTGSGTEFTLTISNLQSEDFAVYYCQQYENWPPWTFGQGTKVEIK

SEQ ID NO: 703 - protein, 123 aa, Homo sapiens
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDAIVVVNYYYGMDVWGQGTTVTVSS

SEQ ID NO: 704 - protein, 106 aa, Homo sapiens
DIQMTQSPLLLLWLPGDRVTITCRASQSISTWLAWYQQKPGKAPKLLIYKASSVESGVPSRFSGSGSGTEFTLTISSLQPDDLGTYYCQQYSTYSTFGQGTKVDIK

SEQ ID NO: 705 - protein, 121 aa, Homo sapiens
EEKLLESGGGLVKPGGSLRLSCTASGFVFKNYVMSWVRRAPGRGLEWISGIRGGDQMTFYANSVKGRFIISRDNVKNMVHLQMNDLRDDDTAIYYCTKVVVESLKNWFDAWGQGTLVTVTS

SEQ ID NO: 706 - protein, 111 aa, Homo sapiens; identical to SEQ ID NO: 660

SEQ ID NO: 707 - protein, 121 aa, Homo sapiens; identical to SEQ ID NO: 659

SEQ ID NO: 708 - protein, 108 aa, Homo sapiens
EIVLTQSPGTLSLSPGERAILSCRASQTVISGYLAWYQQKPGQTPRLLISGASSRATGIPDRFSGSGSGTDFTLTISRLEPEDFAVYYCQQYGSSPYTFGQGTKLEIK

SEQ ID NO: 709 - protein, 119 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARKDIYYYYMDVWGKGTTVTVSS

SEQ ID NO: 710 - protein, 112 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPVVFGGGTKLTVL

SEQ ID NO: 711 - protein, 123 aa, Homo sapiens
QVQLVQSGTEVKKPGSSVKVSCKASGGTFSSYAISWVRQAPGQGLEWMGRIIPILGIANYAQKFQGRVTITADKSTSTAYMELSSLRSEDTAVYYCARDAIVVVNYYYGMDVWGQGTTVTVSS

SEQ ID NO: 712 - protein, 111 aa, Homo sapiens; identical to SEQ ID NO: 652

SEQ ID NO: 713 - protein, 133 aa, Homo sapiens
EVQLVESGGGLVKPGGSLRLSCAASGLTFSNAWMNWVRQAPGKGLEWVGRIKSKADGGTTDYAVPVKDRFTISRDDSKNTLFLQMNSLKTEDTAVYYCTTITGSTYSFRFSTYYYYYYYLDVWGKGTTVTVTS

SEQ ID NO: 714 - protein, 108 aa, Homo sapiens; identical to SEQ ID NO: 592

SEQ ID NO: 715 - protein, 121 aa, Homo sapiens; identical to SEQ ID NO: 669

SEQ ID NO: 716 - protein, 108 aa, Homo sapiens
EIVLTQSPGTLSLSPGERATLSCRASQSVSSIYLAWYQQKPGQAPRLLIYGASSRATGIPDRFSGSGSGTDFTLTISRLEPEDFAVYYCQQYGSSPWTFGQGTKVEIK

SEQ ID NO: 717 - protein, 121 aa, Homo sapiens
EEQLLESGGGLVKPGGSLSLSCTASGFVFRSYVMSWVRRAPGRGLEWISGIRGGDQMTFYANSVKGRFIISRDNVKNMVHLQMNDLRDDDTAIYYCTKVIGESLENWFDAWGKGTLVTVTS

SEQ ID NO: 718 - protein, 111 aa, Homo sapiens; identical to SEQ ID NO: 652

SEQ ID NO: 719 - protein, 123 aa, Homo sapiens; identical to SEQ ID NO: 703

SEQ ID NO: 720 - protein, 113 aa, Homo sapiens; identical to SEQ ID NO: 692

SEQ ID NO: 721 - protein, 132 aa, Homo sapiens
EVQLVESGGGLVKPGGSLRLSCAASGLTFSNAWMNWVRQAPGKGLEWVGRIKSKADGGTTDYAVPVKDRFTISRDDSKNTLFLQMNSLKTEDTAVYYCTTITGSTYSFRFSTYYYYYYLDAWGQGTLVTVTS

SEQ ID NO: 722 - protein, 108 aa, Homo sapiens; identical to SEQ ID NO: 588

SEQ ID NO: 723 - protein, 121 aa, Homo sapiens
EEKLLESGGGLVKPGGSLRLSCTASGFVFKNYVMSWVRRAPGRGLEWISGIRGGDQMTFYANSVKGRFIISRDNVKNMVHLQMNDLRDDDTAIYYCTKVVVESLENWFDAWGQGTLVTVLE

SEQ ID NO: 724 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPGYTFGQGTKLEIK

SEQ ID NO: 725 - protein, 121 aa, Homo sapiens; identical to SEQ ID NO: 651

SEQ ID NO: 726 - protein, 111 aa, Homo sapiens
PSVLTQLRSASGPPGQRVTISWSGSRSHIGSNPVNWYQPLPGPAHKLLIFGNDQRPSGVPDRFSGSKSGTSASLAISGLQSEDEADYYCAAWDDTLNGLYVFGTGIFFFKQ

SEQ ID NO: 727 - protein, 129 aa, Homo sapiens
QVQLVQSGAEVMQVGASVKVSCKASGYTFTGYYMHWVRQAPGQGLEWMGLINPNSGGTNYAQKFQGWVTMTRDTSISTAYMELSRLRSDDTAVYYCARDGSGVVPAAISSYYYYGMDVWGQGTTVTVSS

SEQ ID NO: 728 - protein, 108 aa, Homo sapiens
EIVLTQSPGTLSLSPGERATLSCRASQSVRGTYLAWYQQKPGQAPRLVIYAASSRATGIPDRFSGSGSGTDFTLTISRLEPEDFAVYYCQQYGSSPGTFGQGTKLEIK

SEQ ID NO: 729 - protein, 120 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCALVTAIPPYYFDYWGQGTLVTVSS

SEQ ID NO: 730 - protein, 111 aa, Homo sapiens
QSVLTQPPSASGTPGQTVTISCSGSSSNIGSNYVYWYQQVPGTAPQLLIYRNNQRPSGVPDRFSGSKSGTSASLAISGLRSGDEADYYCAAWDDSLSGHVVFGGGTKVTVL

SEQ ID NO: 731 - protein, 123 aa, Homo sapiens
QVQLQQWGAGLLKPSETLSLTCGVYGGSFTGYYWSWIRQAPGKGLEWIGEINHNGRSTNYNPSLKSRVTISVDTSNNQFSLKVRSVTAADTAVYYCARERDYNHYYYWHMDVWGKGTTVTVSS

SEQ ID NO: 732 - protein, 108 aa, Homo sapiens; identical to SEQ ID NO: 728

SEQ ID NO: 733 - protein, 120 aa, Homo sapiens
QVQLVQSGAEVKKPGASVKLSCKASGYSFTTYTMSWVRQAPGRGLEWMGWINPANGHTEYMERFRGRVTITRDTSASTAYMELSSLTSEDTTIYFCARIYCSGDHCYDYWGQGILVTVSS

SEQ ID NO: 734 - protein, 108 aa, Homo sapiens; identical to SEQ ID NO: 728

SEQ ID NO: 735 - protein, 120 aa, Homo sapiens
QVQLVQSGAEVKKPGASVKVSCTTSGFIFISHYMHWVRQAPGQGLEWMGIITPANTTKYSQRFQGRVTMTSDASTSTVYMELSSLRSEDTAVYYCAREWGELDSSVFDYWGQGTLVTVSA

SEQ ID NO: 736 - protein, 111 aa, Homo sapiens
QSVLTQSPSASASLGASVKLTCTLSSGHTNYAIAWHQQQPDKGPRFLMRLNSDGSHIKGDGIPDRFSGSSSGPERYLTISSLQSEDEADYYCQTWGTGTQVFGTGTKVTVL

SEQ ID NO: 737 - protein, 129 aa, Homo sapiens
QVQLVQSGAEVMQVGASVKVSCKASGYTFTGYYMHWVRQAPGQGLEWMGWINPNSGGTNYAQKFQGWVTMTRDTSISTAYMELSRLRSDDTAVYYCARDGSGVVPAAISSYYYYGMDVWGQGTTVTVSS

SEQ ID NO: 738 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSNWVFGGGTKLTVL

SEQ ID NO: 739 - protein, 126 aa, Homo sapiens
QVQLVQSGAEVMQVGASVKVSCKASNYTFTSFGINWVRQAPGQGLEWMGWISPYNGNTNYAQDLQGRVTMTTDTSTSTAYMELRSLRSDDTAVYYCARERDHNYSNFYYYYGMDVWGQGTTVTVSS

SEQ ID NO: 740 - protein, 108 aa, Homo sapiens; identical to SEQ ID NO: 728

SEQ ID NO: 741 - protein, 120 aa, Homo sapiens
QVQLVQSGAEVMQVGASVKVSCTTSGFIFISHYMHWVRQAPGQGLGWMGIITPANTTKYSQRFQGRVTMTSDASTSTVYMELSSLRSEDTAVYYCAREWGELDSSVFDYWGQGTLVTVSA

SEQ ID NO: 742 - protein, 108 aa, Homo sapiens; identical to SEQ ID NO: 728

SEQ ID NO: 743 - protein, 123 aa, Homo sapiens
EVQLVESGGGLVKPGGSLRLSCAASIFTFSDYTMNWVRQAPGKGLEWVSSISSTGTYIYYAGSVRGRFTISRDNAKKLLYLQMNGLRAEDTAVYYCTRELTTVTRFRYWFDPWGQGTQVTVSS

SEQ ID NO: 744 - protein, 111 aa, Homo sapiens
QSVLTQPPSVSGAPGQRVTISCTGSSSNIGAGFDVHWYQQLPGTAPKLLIYDNSNRPSGVPDRFSGSKSGTSASLAITGLQAEDEAHYYCQSYDSTLIGSVFGGGTKLTVL

SEQ ID NO: 745 - protein, 125 aa, Homo sapiens
EVQLVQSGAEVKKPGESLKISCKVSGYNFASYCIGWVRQMPGKGLEWMGIIFPGDSDTRYSPSFQGQVTFSADKSISTAYLQWSSLKASDTAMYYCARGRVLVRGVISEDYFDYWGHGTLVTVSS

SEQ ID NO: 746 - protein, 111 aa, Homo sapiens; identical to SEQ ID NO: 736

SEQ ID NO: 747 - protein, 123 aa, Homo sapiens
EVQLVQSGAEVKKPGESLKISCKGSGYSFPNYWIGWVRQMSGQGLEWMAIIYPGNSDTRYSPSLQDQVTISADKSISTAYLQWSSLKASDTAMYFCARLSYFGSGTYYPFDYWGQGTLVTVSS

SEQ ID NO: 748 - protein, 108 aa, Homo sapiens
EIVLTQSPGTLSLSPGERVTLSCRTSQSVSGDYLAWYRQKPGQPPRLLVYRTSSRATGIPDRFSGSGSRTDFTLSISGLEPEDFAVYYCQHYGSSHYTFGQGTKLEIK

SEQ ID NO: 749 - protein, 125 aa, Homo sapiens
QVQLVQSGAEVMQVGASVKVSCKAYGYTFSTHGISWVRQAPGQGLEWMGWISAYNGDTKFAQKVQGRVTMTTDTSTSTAYMELRSLRSDDTAMYFCAREGADYGDRESMDAFDIWGRGTMVTVSS

SEQ ID NO: 750 - protein, 110 aa, Homo sapiens
QSVLTQPPSVSGAPGQRVAFSCTGSSSNIGAGFDVHWYQQLPGTAPKLLIYANSNRPSGVPDRFSGSKSGTSASLAITGLQVEDEADYYCQSYDSSLSWVFGGGTKLTVL

SEQ ID NO: 751 - protein, 121 aa, Homo sapiens; identical to SEQ ID NO: 651

SEQ ID NO: 752 - protein, 108 aa, Homo sapiens; identical to SEQ ID NO: 728

SEQ ID NO: 753 - protein, 120 aa, Homo sapiens
QVQLVQSGAEVKKPRPSLKVSCKASGGTFTGYAISWVRHAPGQGLQWLGGIIPIFGTANYAQKFQGRVTITADESTSTAYMELSSLRSEDTAVYYCALVTAIPPYYFDYWGQGTLVTVSS

SEQ ID NO: 754 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVFGGGTKLTVL

SEQ ID NO: 755 - protein, 126 aa, Homo sapiens
QVQLQESGPGLVKPSETLSLTCTVSGASVTSNNYYWSWVRQPPGKGLEWIGHISYRGITNYIPSLKSRVTISADTSKNQFSLNLKSVIDADTAVYYCVREDLVSQSRYYYYYMDVWGKGTTVTVSS

SEQ ID NO: 756 - protein, 108 aa, Homo sapiens
EIVLTQSPATLSLSPGERATLSCRASQSVSSSYLAWYQQKPGQAPRLLIYGASSRATGTPDRFSGSGSGTDFTLTISRLEPEDFAVYYCQQYGSSPYTFGQGTKLEIK

SEQ ID NO: 757 - protein, 122 aa, Homo sapiens
QVQLVQSGAEVMQVGASVKVSCKASGYTFTLYAMHWVRQAPGQRLEWLGWINAGNGDTKYSQKFQGRVTITRDTPASTAYMELSSLRSEDTAIYYCARDKEGWNDPNYFDFWGQGTLVTVSS

SEQ ID NO: 758 - protein, 110 aa, Homo sapiens
QSALTQPASVSGSPGQSITISCTGTSSDVGGHNYVSWYQQYPGKAPKLMIYDVSNRPSGVSNRFSASKSGNTASLTISGLQAEDEGDYYCSSYTSRSTLVFGGGTKLTVL

SEQ ID NO: 759 - protein, 122 aa, Homo sapiens; identical to SEQ ID NO: 757

SEQ ID NO: 760 - protein, 107 aa, Homo sapiens
QSVLTQPPSLSAAPGQKVTISCSGSSKIDYVSWYQQFPGTAPKLLIYDNSHRPSGIPDRFSGSKSGTSATLGITGLQTGDEADYYCGTWDSRLNVYVFGPGTKVTVL

SEQ ID NO: 761 - protein, 128 aa, Homo sapiens; identical to SEQ ID NO: 623

SEQ ID NO: 762 - protein, 106 aa, Homo sapiens
DIQVTQSPSTLSASVGDRVTITCRGSQRLTNWLAWYQQKPGKAPKLLIYKASILHSGVPSRFSGSESGTEFTLTISSVQPDDFATYYCQHYDTYWTFGQGTKVEIK

SEQ ID NO: 763 - protein, 122 aa, Homo sapiens; identical to SEQ ID NO: 583

SEQ ID NO: 764 - protein, 108 aa, Homo sapiens; identical to SEQ ID NO: 756

SEQ ID NO: 765 - protein, 127 aa, Homo sapiens; identical to SEQ ID NO: 597

SEQ ID NO: 766 - protein, 110 aa, Homo sapiens
QSALTQPASVSGSPGQSITISCTGTSSDVGGHNYVSWYQQYPGKAPKLMIYDVSNRPSGFSNRFSASKSGNTASLTISGLQAEDEGDYYCSSYTSRSTLVFGGGTKLTVL

SEQ ID NO: 767 - protein, 131 aa, Homo sapiens
QVQLVQSGAEVMQVGASVKVSCKASGYTFINYGISWVRQAPGQGLEWMGWISTYNGNTDFAQKLQGRFTMTTDTSASTAYMEVRSLRSDDTAVYYCARDRRLGTPASGWTADYSYSYMDVWGTGTTVTVSS

SEQ ID NO: 768 - protein, 108 aa, Homo sapiens
EIVLTQSPATLSLSLGERATLSCRASQSVRRYLAWFQQRPGQSPRLLIYDASNRATGIPARFSGSGSGTDFTLTISSLEPEDFAIYYCQQRSHWPKYTFGQGTKLEIK

SEQ ID NO: 769 - protein, 124 aa, Homo sapiens
EVQLVESGGDLVQPGGSLRLSCAASGFSFSSFSMTWVRQAPGKGLEWVAYISGNGYIIYYTDSVKGRFTISRDNARNSLYLQLNSLRAEDTAVYFCASWVDSRGYYYVDYFDNWGQGTLVTVSS

SEQ ID NO: 770 - protein, 108 aa, Homo sapiens; identical to SEQ ID NO: 756

SEQ ID NO: 771 - protein, 121 aa, Homo sapiens; identical to SEQ ID NO: 651

SEQ ID NO: 772 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVFGGRTKLTVL

SEQ ID NO: 773 - protein, 127 aa, Homo sapiens; identical to SEQ ID NO: 597

SEQ ID NO: 774 - protein, 109 aa, Homo sapiens; identical to SEQ ID NO: 564

SEQ ID NO: 775 - protein, 122 aa, Homo sapiens; identical to SEQ ID NO: 583

SEQ ID NO: 776 - protein, 111 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTFVVFGGGTKLTVL

SEQ ID NO: 777 - protein, 126 aa, Homo sapiens
EVQLVESGGGLVQPGGSLRLSCAASGFTFSDHYMDWVRQAPGKWLEWVGRTRNRAKSYTTEYAASVKGRFTISRDDSKNSLYLQMNSLKTEDTAVYYCARARPLGGSGTNYGMDVWGQGTTVTVSS

SEQ ID NO: 778 - protein, 108 aa, Homo sapiens; identical to SEQ ID NO: 756

SEQ ID NO: 779 - protein, 125 aa, Homo sapiens; identical to SEQ ID NO: 605

SEQ ID NO: 780 - protein, 107 aa, Homo sapiens; identical to SEQ ID NO: 760

SEQ ID NO: 781 - protein, 129 aa, Homo sapiens; identical to SEQ ID NO: 409

SEQ ID NO: 782 - protein, 110 aa, Homo sapiens
QSALTQPASVSGSPGQSITISCTGTSSDVVTYNLVSWYQQHPGKAPKLIIYEATKRPSGVSNRFSGSKSGNTASLTISGLQAEDEADYYCCSYAGTSSVVFGGGTKLTVL

SEQ ID NO: 783 - protein, 125 aa, Homo sapiens; identical to SEQ ID NO: 565

SEQ ID NO: 784 - protein, 111 aa, Homo sapiens; identical to SEQ ID NO: 776

SEQ ID NO: 785 - protein, 125 aa, Homo sapiens; identical to SEQ ID NO: 565

SEQ ID NO: 786 - protein, 110 aa, Homo sapiens; identical to SEQ ID NO: 758

SEQ ID NO: 787 - protein, 125 aa, Homo sapiens; identical to SEQ ID NO: 565

SEQ ID NO: 788 - protein, 102 aa, Homo sapiens
DIQMTQSPSSLSASVGDRVTITCRASQGISNYLAWYQQKPGKVPKLLIYAASTLYPGVPSRFSGSGSGTDFTLTISSLQPEDVATYYCQTLTFGGGTKVEIK

SEQ ID NO: 789 - protein, 125 aa, Homo sapiens
EVHLVESGGGLVKPGESLRLSCEASGFTFTNAWMSWVRQAPGKGLEWIGRIKGESEGGTADYAAPVKGRFSMSRDNSKNIVYLQMNSLKTEDTATYYCVTKLGTALWVIDYFDNWGQGTLVTVSS

SEQ ID NO: 790 - protein, 110 aa, Homo sapiens; identical to SEQ ID NO: 758

SEQ ID NO: 791 - protein, 124 aa, Homo sapiens
EVQLVESGGDLVQPGGSLRLSCAASGFSFSSFSMTWVRQAPGKGLEWVAYISGNGYIIYYTDSVKGRFTISRDNARNSLYLQLNSLRAEDTAVYFCASWVDSRGYYYVDYFDNWGQGTLVTVFL

SEQ ID NO: 792 - protein, 107 aa, Homo sapiens; identical to SEQ ID NO: 760

SEQ ID NO: 793 - protein, 130 aa, Homo sapiens
QVQLQQKGAALLKPSETLSLTCGVSGGTFSDYHWTWVRQPPGKGLEWIGKINHGGSTNYNPTLKSRVSISIDTSKSQFSLKMTSLTAADAAVYFCARLREGRALRLTSQPRYSYYHMDVWGKGTTVTVSS

SEQ ID NO: 794 - protein, 110 aa, Homo sapiens; identical to SEQ ID NO: 772

SEQ ID NO: 795 - protein, 125 aa, Homo sapiens
EVQLLESGGGSVQPGGSLRLSCAASGFSFSSYVMGWVRQAPGKGLEWVSAISGSGGSTYYANSVKGRFTISRDNSKNTLSLQMNSLRVEDTAVFYCAKEATGDCGGDCVRWFDPWGQGTLVTVSS

SEQ ID NO: 796 - protein, 107 aa, Homo sapiens
DIQMTQSPSSVSASIGDRVTITCRASQGINRWLAWYQQKPGKAPRLLIYAASSLQSGVPSRFSGSGSGTDFTLTISSLQPEDFATYSCQQAQTFPLTFGGGTKVEIK

SEQ ID NO: 797 - protein, 121 aa, Homo sapiens; identical to SEQ ID NO: 659

SEQ ID NO: 798 - protein, 107 aa, Homo sapiens; identical to SEQ ID NO: 760

SEQ ID NO: 799 - protein, 125 aa, Homo sapiens; identical to SEQ ID NO: 605

SEQ ID NO: 800 - protein, 108 aa, Homo sapiens
DIQMTQSPSPLSASVGDRVTIYCRASQSISNFLNWYQQRPGKAPKLLIYATSSLQSGVSSRFSGHGFGTEFTLTISSLQPEDFATYYCQQSYTTSQLTFGPGTKVEIK

SEQ ID NO: 801 - protein, 129 aa, Homo sapiens
QVQLVESGGGVVQPGRSLRLSCAASGFTFSSYGMHWVRQAPGKGLEWVAVISYDGSNKYYTDSVKGRFTISRDNSINTLYLQMNSLRAEDSAVYYCAKDRDRSAYNYGPAMAREYFQHWGQGTLVTVSS

SEQ ID NO: 802 - protein, 110 aa, Homo sapiens; identical to SEQ ID NO: 758

SEQ ID NO: 803 - protein, 124 aa, Homo sapiens; identical to SEQ ID NO: 769

SEQ ID NO: 804 - protein, 108 aa, Homo sapiens; identical to SEQ ID NO: 260

SEQ ID NO: 805 - protein, 124 aa, Homo sapiens
EVQLVESGGGSVQPGGSLRLSCTTSGFSFSRYWMSWVRQAPGKGLEWVANIKQDGSEKYYVDSVEGRFTISRDNAKNSLYLQMNSLRAEDTAVYFCARDQLGGAVVPADYFDYWGQGTLVTVSS

SEQ ID NO: 806 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 807 - protein, 125 aa, Homo sapiens; identical to SEQ ID NO: 565

SEQ ID NO: 808 - protein, 106 aa, Homo sapiens; identical to SEQ ID NO: 806

SEQ ID NO: 809 - protein, 122 aa, Homo sapiens; identical to SEQ ID NO: 583

SEQ ID NO: 810 - protein, 107 aa, Homo sapiens
DIQMTQSPSSLSAYVGDRVTITCRTSQSISSYLNWYKQKPGEAPKLLMYAASTLQSGVPSRFSGRGSGTDFTLTISNLQADDSATYYCQQSYSTPPTFGQGTKVEIK

SEQ ID NO: 811 - protein, 122 aa, Homo sapiens; identical to SEQ ID NO: 583

SEQ ID NO: 812 - protein, 110 aa, Homo sapiens; identical to SEQ ID NO: 758

SEQ ID NO: 813 - protein, 122 aa, Homo sapiens; identical to SEQ ID NO: 757

SEQ ID NO: 814 - protein, 110 aa, Homo sapiens
QSVLTQPPSVSAAPGQNVTISCSGSSSNIGNYLVSWYQHLPGTAPKLLIYDNNKRPSGIPDRFSGSKSGTSATLGITGLQTGDEGDYFCGTWDNSLSGGVFGGGTKLTVL

SEQ ID NO: 815 - protein, 124 aa, Homo sapiens; identical to SEQ ID NO: 805

SEQ ID NO: 816 - protein, 108 aa, Homo sapiens
EIVLTQSPATLSLSPGERATLSCRASVNIAMSLAWFQQKPGQVPRLLIYDASHRATGIPARFSGSGSVTDFTLTISSLEAEDFAVYYCQQRASWPKVTFGGGTKVEIT

SEQ ID NO: 817 - protein, 130 aa, Homo sapiens; identical to SEQ ID NO: 793

SEQ ID NO: 818 - protein, 108 aa, Homo sapiens; identical to SEQ ID NO: 756

SEQ ID NO: 819 - protein, 122 aa, Homo sapiens
QVQLVESGGGVVQPGRSLRLSCAASGFTLRNYAMHWVRQAPGKGLEWVAVLSYDGNNKKYADSVKGRFTISRDISNNTLYLHMDSLRAEDRAVYYCARYRTPYSSGWYVGYWGQGTLVTVSS

SEQ ID NO: 820 - protein, 108 aa, Homo sapiens; identical to SEQ ID NO: 816

SEQ ID NO: 821 - protein, 122 aa, Homo sapiens
AVQLLESGGGLIQPGGSLRLSCAASGFTFSTYAMGWVRQAPGKGLEWVSAISHSSDSTYYADSVKGRFTISRDNSKNTLYLQMNSLRAEDTAVYYCAKPSGSSWSLLYFDYWGQGTLVTVSS

SEQ ID NO: 822 - protein, 110 aa, Homo sapiens; identical to SEQ ID NO: 632

SEQ ID NO: 823 - protein, 128 aa, Homo sapiens
EVQLVESGGGLVQPGGSLRLSCAASGFTFSNYWMHWVRPAPGKGLVVVARISGDGSDADYADSVRGRFTISRDNAKNTLFLQMNSLRVEDTAVYYCVRDRDVRDCNNGVCHTAYFNYWGQGTLVTVSS

SEQ ID NO: 824 - protein, 107 aa, Homo sapiens
DIQMTQSPSTLSASVGDRVTITCRASQSISRWLAWHQQKPGKAPNLLIYEASSLESGVPSRFSGSGSGTEFTFTISSLQPDDFATYYCQHYKSYPLTFGGGTKVEIK

SEQ ID NO: 825 - protein, 127 aa, Homo sapiens; identical to SEQ ID NO: 617

SEQ ID NO: 826 - protein, 108 aa, Homo sapiens
EIVLTQSPGTLSLSPGERATLSCRASQNVIRDYLAWYQQKPGQAPRLLIFGTSNRATGIPDRFSGSGSGTDFTLTINRLAPDDFAVYYCQHYGSSLFTFGPGTKLDIK

SEQ ID NO: 827 - protein, 119 aa, Homo sapiens
QVHLVESGGGVVQPGRSLRLSCAASGFSFSSYGLHWVRQAPGKGLEWVAFISHVGSNKYYADSVKGRFTISRDNSKNTLYLQMNSLRTEDTAVYYCAREHTVGGIFGFWGQGTLVTVSS

SEQ ID NO: 828 - protein, 111 aa, Homo sapiens
QSVLTQPPSASGTPGQRVTISCSGSSSNIGSYTVNWYQQLPGTAPKLLIYNNNQRPSGVPDRFSGSKSGTSASLAISGLQSEDEADYYCAAWDDSLNGHVVFGGGTKLTVL

SEQ ID NO: 829 - protein, 134 aa, Homo sapiens; identical to SEQ ID NO: 665

SEQ ID NO: 830 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEDDYYCQSYDSRLSGWVFGGGTKLTVL

SEQ ID NO: 831 - protein, 119 aa, Homo sapiens; identical to SEQ ID NO: 399

SEQ ID NO: 832 - protein, 111 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTHVVFGGGTKLTVL

SEQ ID NO: 833 - protein, 123 aa, Homo sapiens
QVQLVQSGAEVMQVGASVKVSCKTSGYTFTSYYLHWVRQAPGQGLEWMGIINPSGGSTSYAQKFQGRVTMTRDTSTSTVYMELSSLRSEDTAVYYCARGALTMVRAVEYFQHWGQGTLVTVSS

SEQ ID NO: 834 - protein, 107 aa, Homo sapiens; identical to SEQ ID NO: 824

SEQ ID NO: 835 - protein, 126 aa, Homo sapiens
EVQLVESGGGLVQPGGSLRLSCAASGFTFSDHYMDWVRQAPGKGLEWVGRTRNRAKSYTTEYAASVKGRFTISRDDSKNSLYLQMNSLKTEDTAVYYCARARPLGGSGTNYSMDVWDQGTTVTVSS

SEQ ID NO: 836 - protein, 107 aa, Homo sapiens; identical to SEQ ID NO: 616

SEQ ID NO: 837 - protein, 129 aa, Homo sapiens; identical to SEQ ID NO: 409

SEQ ID NO: 838 - protein, 111 aa, Homo sapiens; identical to SEQ ID NO: 828

SEQ ID NO: 839 - protein, 123 aa, Homo sapiens; identical to SEQ ID NO: 833

SEQ ID NO: 840 - protein, 111 aa, Homo sapiens; identical to SEQ ID NO: 832

SEQ ID NO: 841 - protein, 122 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPRTTVTTGRWFDPWGQGTLVTVSS

SEQ ID NO: 842 - protein, 107 aa, Homo sapiens; identical to SEQ ID NO: 700

SEQ ID NO: 843 - protein, 134 aa, Homo sapiens; identical to SEQ ID NO: 665

SEQ ID NO: 844 - protein, 110 aa, Homo sapiens; identical to SEQ ID NO: 632

SEQ ID NO: 845 - protein, 137 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLRRDIVVVPAANRGGGSSWQNYYYYYMDVWGKGTTVTVSS

SEQ ID NO: 846 - protein, 107 aa, Homo sapiens
AIRMTQSPSSFSASTGDRVTITCRASQGISSYLAWYQQKPGKAPKLLIYAASTLQSGVPSRFSGSGSGTDFTLTISCLQSEDFATYYCQQYYSYPRTFGQGTKVEIK

SEQ ID NO: 847 - protein, 122 aa, Homo sapiens
QVQLQQSGPGLVKPSQTLSLTCAISGDSVSSESVAWNWIRQSPSRGLEWLGRTYYRSRWYSDYAVSVKSRITINPDTSKNQFSLQVSSMTPEDTAVYYCARMFSSSGHFDYWGQGTLVTVSS

SEQ ID NO: 848 - protein, 110 aa, Homo sapiens
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTPVFGGGTKLTVL

SEQ ID NO: 849 - protein, 127 aa, Homo sapiens
QLQLVESGGGVVQTGRSLRLSCLASGFTLSGFAMHWVRQTPHKGLEWVAVISSDGGDIYYADSVKGRFTISRDNFKNTIFLQMNNLRGDDTAVYFCVRPQSQLDRSGSSYFVTFDIWGQGTMVTVSS

SEQ ID NO: 850 - protein, 108 aa, Homo sapiens
EIVMTQSPATLSVSPGERATLSCRASQSISTNLAWYQQKPGQAPRVLIYGASTRATDVPDRFSGTGSGTDFTLTISSLQSEDFAIYYCQQYHNWPPETFGQGTKVEIK

SEQ ID NO: 851 - protein, 120 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARDEGGVGGWFDPWGQGTLVTVSS

SEQ ID NO: 852 - protein, 108 aa, Homo sapiens; identical to SEQ ID NO: 826

SEQ ID NO: 853 - protein, 132 aa, Homo sapiens
KIQLQESGPGLVKPSQTLSPTCTVSGGSLSSGDYYWSWIRQPPGKGLEWIGYIYYSGSTSHNPSLKSRVSISVDTSKNQFSLKLSSVSAADTAVYYCARYYYATSGFYERPPGPRFNWFDPWGQGTLVTVSS

SEQ ID NO: 854 - protein, 107 aa, Homo sapiens
EIVLTQSPATLSLSPGERATLSCRASQSVSSYLAWYQQKPGQAPRLLIYGASNRATGIPARFSGSGSGTDFTLTISSLEPEDFAVYYCQQRSNWPLTFGGGTKVEIK

SEQ ID NO: 855 - protein, 125 aa, Homo sapiens; identical to SEQ ID NO: 605

SEQ ID NO: 856 - protein, 107 aa, Homo sapiens
DIQMTQSPSSLSASVGDRVTITCRASQSISNYLNWYQQKPGKAPKLLIYAASSLQSGVPSRFSGSGSGTDFTLTISSLQPENFATYYCQQSYSAPHTFGPGTKVDIK

SEQ ID NO: 857 - protein, 122 aa, Homo sapiens; identical to SEQ ID NO: 593

SEQ ID NO: 858 - protein, 111 aa, Homo sapiens; identical to SEQ ID NO: 830

SEQ ID NO: 859 - protein, 122 aa, Homo sapiens; identical to SEQ ID NO: 593

SEQ ID NO: 860 - protein, 107 aa, Homo sapiens; identical to SEQ ID NO: 700

SEQ ID NO: 861 - protein, 122 aa, Homo sapiens; identical to SEQ ID NO: 841

SEQ ID NO: 862 - protein, 111 aa, Homo sapiens; identical to SEQ ID NO: 830

SEQ ID NO: 863 - protein, 128 aa, Homo sapiens; identical to SEQ ID NO: 623

SEQ ID NO: 864 - protein, 111 aa, Homo sapiens; identical to SEQ ID NO: 830

SEQ ID NO: 865 - protein, 122 aa, Homo sapiens; identical to SEQ ID NO: 593

SEQ ID NO: 866 - protein, 107 aa, Homo sapiens; identical to SEQ ID NO: 796

SEQ ID NO: 867 - protein, 134 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLRRDIVVVPAANRGGGSRWQNYYYYYMDVWGKGPIGL

SEQ ID NO: 868 - protein, 108 aa, Homo sapiens; identical to SEQ ID NO: 592

SEQ ID NO: 869 - protein, 136 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLRRDIVVVPAANRGGGSSWQNYYYYMDVWGKGTTVTVSS

SEQ ID NO: 870 - protein, 111 aa, Homo sapiens
SFMLTQPHSVSESPGKTVTISCTRSSGSIASNYVQWYQQRPGSSPTTVIYENNQRPSGVPDRFSGSIDSSSNSASLTISGLKTEDEADYYCHSYDANKRGVFGGGTKLTVL

SEQ ID NO: 871 - protein, 122 aa, Homo sapiens
QVQLVESGGGVVQPGRSLRLSCAASGFTFSNYAMHWVRQAPGKGLEWVAVILDDGSNKYYADSVKGRFTISRDNSKNTLYLQMNSLRAEDTAVYYCARASEMATIEDAFDIWGQGTMVTVSL

SEQ ID NO: 872 - protein, 107 aa, Homo sapiens [sequence omitted]

SEQ ID NO: 873 - protein, 121 aa, Homo sapiens
QLQLQESGPGLVNPWETLTLTCSVSGASISSISYNWGWVRQPPGKGLEWIGNIYFTGTTHYNPSLNSRVTISVDTSRNQFSLTLSSVTAADTAMYYCVREGQTVTTWFDPWGQGTLVTVSS

SEQ ID NO: 874 - protein, 108 aa, Homo sapiens; identical to SEQ ID NO: 826

SEQ ID NO: 875 - protein, 118 aa, Homo sapiens
EVQLLESGGGLVQPGGSLRLSCAASGFTFSTYATTWVRQAPGKGLEWVSAISGSGGSTYYADSVKGRFTISRDNSKNTLYLQMNSLRAEDTAVYYCATVKQWLALDYWGQGTLVTVSS

SEQ ID NO: 876 - protein, 108 aa, Homo sapiens; identical to SEQ ID NO: 592

SEQ ID NO: 877 - protein, 123 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARPLGGSGTNYGMDVWGQGTTVTVSS

SEQ ID NO: 878 - protein, 108 aa, Homo sapiens; identical to SEQ ID NO: 592

SEQ ID NO: 879 - protein, 123 aa, Homo sapiens; identical to SEQ ID NO: 833

SEQ ID NO: 880 - protein, 107 aa, Homo sapiens; identical to SEQ ID NO: 854

SEQ ID NO: 881 - protein, 121 aa, Homo sapiens; identical to SEQ ID NO: 659

SEQ ID NO: 882 - protein, 108 aa, Homo sapiens; identical to SEQ ID NO: 588

SEQ ID NO: 883 - protein, 122 aa, Homo sapiens; identical to SEQ ID NO: 593

SEQ ID NO: 884 - protein, 109 aa, Homo sapiens; identical to SEQ ID NO: 572

SEQ ID NO: 885 - protein, 132 aa, Homo sapiens; identical to SEQ ID NO: 621

SEQ ID NO: 886 - protein, 111 aa, Homo sapiens; identical to SEQ ID NO: 830

SEQ ID NO: 887 - protein, 126 aa, Homo sapiens; identical to SEQ ID NO: 635

SEQ ID NO: 888 - protein, 107 aa, Homo sapiens; identical to SEQ ID NO: 700

SEQ ID NO: 889 - protein, 134 aa, Homo sapiens; identical to SEQ ID NO: 665

SEQ ID NO: 890 - protein, 107 aa, Homo sapiens; identical to SEQ ID NO: 846

SEQ ID NO: 891 - protein, 123 aa, Homo sapiens; identical to SEQ ID NO: 833

SEQ ID NO: 892 - protein, 111 aa, Homo sapiens; identical to SEQ ID NO: 870

SEQ ID NO: 893 - protein, 126 aa, Homo sapiens; identical to SEQ ID NO: 635

SEQ ID NO: 894 - protein, 107 aa, Homo sapiens; identical to SEQ ID NO: 616

SEQ ID NO: 895 - protein, 126 aa, Homo sapiens
QVQLQESGPGLVKPSETLSLTCTVSTGTVRDNMFYWGWIRQSPGKGLEWIGSVFFLGTTYYNPSFKSRATIFVNLSKNQFSLELTSVTAADTAVYYCARENYGDSQRDYHYGMDVWGPGLRVTVSS

SEQ ID NO: 896 - protein, 108 aa, Homo sapiens
EIVMTQSPATLSVSPGEGVTLSCRASRTISNNVAWFQVKPGQGPRLLIYGASNRAAGIPLRFSGSGSGTEFTLTISSVQSEDFAVYYCQHYNNWPGYTFGQGTKLDIK

SEQ ID NO: 897 - protein, 119 aa, Homo sapiens; identical to SEQ ID NO: 399

SEQ ID NO: 898 - protein, 111 aa, Homo sapiens
SFMLTQPHSVSESPGKTVTISCTRSSGSIASNYVQWYQQRPGSSPTTVIYENNQRPSGVPDRFSGSIDSSSNSASLTISGWKTEDEADYYCHSYDANKRGVFGGGTKLTVL

SEQ ID NO: 899 - protein, 117 aa, Homo sapiens
EVQLLESGGGLVQPGGSLRLSCAASGFTFSTYATTWVRQAPGKGLEWVSAISGSGGSTYYADSVKGRFTISRDNSKNTLYLQMNSLRAGTRPYITVQPSSSGWHLTIGAREPWSPSP

SEQ ID NO: 900 - protein, 106 aa, Homo sapiens
SYELTQPPSMSVSPGQTASITCSGDKLGDKYACWYQQKPGQSPVLVIYQDNKRPSGIPERFSGSNSGNTATLTISGTQAMDEADYYCQAWDSGTVLFGGGTKLTVL

SEQ ID NO: 901 - protein, 129 aa, Homo sapiens; identical to SEQ ID NO: 409

SEQ ID NO: 902 - protein, 107 aa, Homo sapiens
EIVLTQSPATLSLSPGERTTLSCRASQSVSSYLAWYQQKPGQAPRLLIYGASNRATGIPARFSGSGSGTDFTLTISSLEPEDFAVYYCQQRSNWPLTFGGGTKVEIK

SEQ ID NO: 903 - protein, 134 aa, Homo sapiens; identical to SEQ ID NO: 665

SEQ ID NO: 904 - protein, 107 aa, Homo sapiens; identical to SEQ ID NO: 596

SEQ ID NO: 905 - protein, 118 aa, Homo sapiens; identical to SEQ ID NO: 875

SEQ ID NO: 906 - protein, 111 aa, Homo sapiens; identical to SEQ ID NO: 830

SEQ ID NO: 907 - protein, 122 aa, Homo sapiens; identical to SEQ ID NO: 593

SEQ ID NO: 908 - protein, 112 aa, Homo sapiens
DIVMTQSPLSLPVTPGEPASISCRSSQSLLYSNGYNSLDWYLQKPGQSPQLLIYLGSNRASGVPDRFSGSGSGTDFTLKISRVEAEDVGVYYCMEALQTPYTFGQGTKLEIK

SEQ ID NO: 909 - protein, 126 aa, Homo sapiens
QVQLVESGGGVVQPGMSLRLSCAASGFTFNSYAIHWVRQAPGKGLEWVAVISYDETSNFYTDSVKGRFTISRDNSKNTVYLQMNSLGVDDTAVYYCARDFYPGSGTNWATNRFDPWGQGTLVTVSS

SEQ ID NO: 910 - protein, 107 aa, Homo sapiens
DIQMTQSPSSLSASVGDRVTITCRASQSVSTYFNWYQHKPGKAPKLLIYAASSLQSGVPSRFTGSGSGTDFTLTISSLQPEDFATYYCQQSYSTPYTFGQGTKLEIK

SEQ ID NO: 911 - protein, 122 aa, Homo sapiens; identical to SEQ ID NO: 841

SEQ ID NO: 912 - protein, 107 aa, Homo sapiens; identical to SEQ ID NO: 910

SEQ ID NO: 913 - protein, 127 aa, Homo sapiens
EVQLVESGGGLVQPGGSLRLPCAASGFTFRTYGMNWVRQAPGKGLEWISYISSSGSTIYYADSVKGRFTISRDNAKNSLFLQMNSLRAEDTAVYYCARGFRRITIRPGNYYYYMDVWGKGTTVTVSS

SEQ ID NO: 914 - protein, 108 aa, Homo sapiens; identical to SEQ ID NO: 592

SEQ ID NO: 915 - protein, 127 aa, Homo sapiens; identical to SEQ ID NO: 913

SEQ ID NO: 916 - protein, 111 aa, Homo sapiens; identical to SEQ ID NO: 870

SEQ ID NO: 917 - protein, 119 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVLRLGELSFRNWGQGTLVTVSS

SEQ ID NO: 918 - protein, 107 aa, Homo sapiens; identical to SEQ ID NO: 846

SEQ ID NO: 919 - protein, 127 aa, Homo sapiens
QLQLVESGGGVVQTGRSLRLSCLASGFTLSGFAMHWVRQTPHKGLEWVAFISSDGGDIYYADSVKGRFTISRDNFKNTIFLQMNNLRGDDTAVYFCVRPQSQLDRSGSSYFVAFDIWGQGTMVTVSS

SEQ ID NO: 920 - protein, 106 aa, Homo sapiens
SYELTQPPSVSVSPGQTASITCSGDKLGDKYTSWYHQKPGQSPVLVIYQNTKRPSGIPERFSGSNSGNTATLTISGTQAMDEADYYCQAWDSSTAVFGGGTKLTVL

SEQ ID NO: 921 - protein, 123 aa, Homo sapiens
QVQLQQWGAGLLKPSETLSLTCAVYGGSFSGYYLSWIRQPPGKGLEWIGEINHSGSTNYNPSLKSRITISVATSKNQFSLKLSSVTAADTAVYYCTRARPLGGSGTNYGMDVWGQGSTVTVSS

SEQ ID NO: 922 - protein, 110 aa, Homo sapiens; identical to SEQ ID NO: 754

SEQ ID NO: 923 - protein, 121 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAKADGTSTVTTFSDYWGQGTLVIVSS

SEQ ID NO: 924 - protein, 111 aa, Homo sapiens; identical to SEQ ID NO: 870

SEQ ID NO: 925 - protein, 118 aa, Homo sapiens; identical to SEQ ID NO: 875

SEQ ID NO: 926 - protein, 108 aa, Homo sapiens; identical to SEQ ID NO: 896

SEQ ID NO: 927 - protein, 120 aa, Homo sapiens
QLQLQESDSGLVKPSQTLSLTCAVSGGSISSGGYSWSWIRQPPGKGLEWIGFIYQSGTTSYNPSLKSRVTISVDRSKNQFSLKLSSVTAADTAVYYCARELGRGTAFEIWGQGTMVTVSS

SEQ ID NO: 928 - protein, 111 aa, Homo sapiens
QSALTQPASVSGSPGQSITISCTGTSSDIGAYNYVSWFQQHPGKAPKLMIYDVNYRPSGVPNRFSGSKSGNTASLTISGLQAEDEADYYCTSYTSSSTLVVFGGGTRLTVL

SEQ ID NO: 929 - protein, 133 aa, Homo sapiens
EVQLVESGGGLVQTGGSLRLSCAASGFTFSRYWMSWVRQAPGKGLEWVANIKQDGSEKYYVASVKGRFTISRDNAKKSLYLQMNSLRAEDTAVYYCARDWEGDGSFWSGFFPTPAQKYGMDVWGQGTTVTVSS

SEQ ID NO: 930 - protein, 107 aa, Homo sapiens; identical to SEQ ID NO: 854

SEQ ID NO: 931 - protein, 126 aa, Homo sapiens; identical to SEQ ID NO: 635

SEQ ID NO: 932 - protein, 109 aa, Homo sapiens; identical to SEQ ID NO: 572

SEQ ID NO: 933 - protein, 119 aa, Homo sapiens
QVQLQESGPGLVKPSETLSLTCTVSGGSISSYYWSWIRQPPGKGLEWIGYIYYSGSTNYNPSLKSRFTISVATPKNHFSLKLSSVTAADTAVYYCARHFAARPGYFDYWGQGTLVTVSS

SEQ ID NO: 934 - protein, 108 aa, Homo sapiens
SYELTQPPSVSVSLGQMARITCSGEALPKKYAYWYQQKPGQFPVLVIYKDSERPSGIPERFSGSSSGTIVTLTISGVQAEDEADYYCLSADSSGTYWVFGGGTKLTVL

SEQ ID NO: 935 - protein, 126 aa, Homo sapiens
QLQLQESGPGLVKPSETLSLPCTVFGVSISSNSYYWGWIRQPPGKGLEWIGSINYSGNTYYNPSLKSRVTISVDTFKNQFSLKLSPVTAADTGMFYCARLPPPRGSAAGRYYFDSWGLGTLVTVSS

SEQ ID NO: 936 - protein, 111 aa, Homo sapiens; identical to SEQ ID NO: 870

SEQ ID NO: 937 - protein, 134 aa, Homo sapiens; identical to SEQ ID NO: 665

SEQ ID NO: 938 - protein, 107 aa, Homo sapiens; identical to SEQ ID NO: 854

SEQ ID NO: 939 - protein, 127 aa, Homo sapiens; identical to SEQ ID NO: 617

SEQ ID NO: 940 - protein, 108 aa, Homo sapiens; identical to SEQ ID NO: 896

SEQ ID NO: 941 - protein, 127 aa, Homo sapiens; identical to SEQ ID NO: 617

SEQ ID NO: 942 - protein, 111 aa, Homo sapiens
QLVLTQPPSASGSPGQRVTLSCSGGSSNIGKNYVYWYQHVPGTAPRLLIYRDHQRPSGVPDRFSGSKSGTSASLAISGLRSEDEADYYCAAWDGSLSGPYVFGTGTKVTVL

SEQ ID NO: 943 - protein, 123 aa, Homo sapiens
QVQLVQSGAEVMQVGASVKVSCKTSGYTFTSYYLHWVRQAPGQGLEWMGIINPSGGSTSYAQKFQGRVTMTRDTSTSTVYMELSSLRSEDTAVYYCAREALTMVRAVEYFQHWGQGTLVTVSS

SEQ ID NO: 944 - protein, 107 aa, Homo sapiens; identical to SEQ ID NO: 856

SEQ ID NO: 945 - protein, 128 aa, Homo sapiens; identical to SEQ ID NO: 603

SEQ ID NO: 946 - protein, 107 aa, Homo sapiens; identical to SEQ ID NO: 854

SEQ ID NO: 947 - protein, 133 aa, Homo sapiens
QVQLEESGAGLVQPGGSRCLSCAASGCTFSSYWMSWVRQAPGKGLEWVGNIKQGGSANYYVASVKGGFTITRDNAKKSLYLQMNSLGAEDTAVYYCARDWEGDGSFWSGFFPTTAQKYDMDVWGKGTTVTVSS

SEQ ID NO: 948 - protein, 111 aa, Homo sapiens; identical to SEQ ID NO: 870

SEQ ID NO: 949 - protein, 117 aa, Homo sapiens
QVQLQESGPGLVKPSETLSLTCTVYGGSISSFYWSWIRQPPGKGLEWIGYIYYSGNTNYNPSLKSRVTISIDTSKNQFSLKLSSVTAADTAVYYCANSYGTGSYYHWGQGTLVTVSS

SEQ ID NO: 950 - protein, 108 aa, Homo sapiens
SYELTQPPSVSVSPGQTARITCSGDALPKKYAYWYQQKSGQAPVLVIYEDSKRPSGIPERFSGSSSGTMATLTISGAQVEDEADYYCYSTDSSGNHWVFGGGTKLTVL

SEQ ID NO: 951 - protein, 126 aa, Homo sapiens
QLQLQESGPGLVKPSETLSLPCTVFGVSISSNSYYWGWIRQPPGKGLEWIGSINYSGNTYYNPSLKSRVTISVDTFKTHFSLKLSPVTAADTGMFYCARLPPPRGSAAGRYYFDSWGLGTLVTVSS

SEQ ID NO: 952 - protein, 109 aa, Homo sapiens; identical to SEQ ID NO: 572

SEQ ID NO: 953 - protein, 119 aa, Homo sapiens; identical to SEQ ID NO: 399

SEQ ID NO: 954 - protein, 112 aa, Homo sapiens; identical to SEQ ID NO: 908

SEQ ID NO: 955 - protein, 120 aa, Homo sapiens; identical to SEQ ID NO: 927

SEQ ID NO: 956 - protein, 108 aa, Homo sapiens; identical to SEQ ID NO: 826

SEQ ID NO: 957 - protein, 124 aa, Homo sapiens
QVQLLESGGGLVQPGGSLSLSCAASGFTFSTYSTTWVRQAPGKGLEWFSAISGSGGSTYYADSVKGRFTISRDNSKNTVYLRVSSLRAEDTAVYYCAGARPLGGSGTNYGMDVWGQGTTVTVSS

SEQ ID NO: 958 - protein, 111 aa, Homo sapiens; identical to SEQ ID NO: 870

SEQ ID NO: 959 - protein, 121 aa, Homo sapiens; identical to SEQ ID NO: 659

SEQ ID NO: 960 - protein, 107 aa, Homo sapiens; identical to SEQ ID NO: 616

SEQ ID NO: 961 - protein, 118 aa, Homo sapiens
QLHLQESGPGLVKPAETLSLTCTVSGASIRSSDYYWVWIRQPPGKGLEWIGSIYHGGSTYYNSSLKSRVTVSADASTNQFSLRLNSVNAADTAVYYCSSRGLRVPAIWGQGTLVTVPS

SEQ ID NO: 962 - protein, 107 aa, Homo sapiens; identical to SEQ ID NO: 846

We claim:

1. A method comprising the steps of: finding a subject needing treatment from a SARS-CoV-2; and administering a therapeutically effective amount of an anti-SARS-CoV-2 antibody to the subject, wherein the anti-SARS-CoV-2 antibody comprises SEQ ID NO: 9, or SEQ ID NO: 1 and SEQ ID NO: 3, or SEQ ID NO: 5 and SEQ ID NO: 7, or SEQ ID NO: 11 and SEQ ID NO: 13, or SEQ ID NO: 15 and SEQ ID NO: 17, or SEQ ID NO: 19 and SEQ ID NO: 21, or SEQ ID NO: 23 and SEQ ID NO: 25, or SEQ ID NO: 27 and SEQ ID NO: 29, or SEQ ID NO: 31 and SEQ ID NO: 33, or SEQ ID NO: 35 and SEQ ID NO: 37, or SEQ ID NO: 99 and SEQ ID NO: 101, or SEQ ID NO: 109 and SEQ ID NO: 111, or SEQ ID NO: 119 and SEQ ID NO: 121, or SEQ ID NO: 129 and SEQ ID NO: 131, or SEQ ID NO: 139 and SEQ ID NO: 141, or SEQ ID NO: 149 and SEQ ID NO: 151.

2. The method of claim 1, wherein the anti-SARS-CoV-2 antibody is a SC2 antibody 3705.

3. The method of claim 1, wherein the anti-SARS-CoV-2 antibody is a SC2 antibody 3417.

4. The method of claim 1, wherein the anti-SARS-CoV-2 antibody is a SC2 antibody 3387.

5. The method of claim 1, wherein the anti-SARS-CoV-2 antibody is a SC2 antibody 3388.

6. The method of claim 1, wherein the anti-SARS-CoV-2 antibody is a SC2 antibody 3396.

7. The method of claim 1, wherein the anti-SARS-CoV-2 antibody is a SC2 antibody 3908.

8. The method of claim 1, wherein the anti-SARS-CoV-2 antibody is a SC2 antibody 3916.

9. The method of claim 1, wherein the anti-SARS-CoV-2 antibody is a SC2 antibody 3929.

10. The method of claim 1, wherein the anti-SARS-CoV-2 antibody is a SC2 antibody 3940.

11. The method of claim 1, wherein the anti-SARS-CoV-2 antibody is produced recombinantly.

12. The method of claim 1, wherein the anti-SARS-COV-2 antibody is an antibody fragment.

13. The method of claim 1, wherein the subject is infected with the SARS-CoV-2.

14. The method of claim 1, wherein the anti-SARS-CoV-2 antibody is given to the subject prophylactically.

* * * * *